United States Patent
Misseri et al.

(10) Patent No.: US 9,499,809 B2
(45) Date of Patent: Nov. 22, 2016

(54) CYAA-BASED CHIMERIC PROTEINS COMPRISING A HETEROLOGOUS POLYPEPTIDE AND THEIR USES IN THE INDUCTION OF IMMUNE RESPONSES

(71) Applicant: GENTICEL, Labege (FR)

(72) Inventors: Yolande Misseri, Dremil-Lafage (FR); Michael Esquerre, Auzielle (FR); Etienne Joly, Fourquevaux (FR)

(73) Assignee: GENTICEL, Labege (FR)

( * ) Notice: Subject to any disclaimer, the term of this patent is extended or adjusted under 35 U.S.C. 154(b) by 0 days.

(21) Appl. No.: 14/416,569

(22) PCT Filed: Jul. 23, 2013

(86) PCT No.: PCT/EP2013/065546
§ 371 (c)(1),
(2) Date: Jan. 22, 2015

(87) PCT Pub. No.: WO2014/016310
PCT Pub. Date: Jan. 30, 2014

(65) Prior Publication Data
US 2015/0184143 A1 Jul. 2, 2015

(30) Foreign Application Priority Data
Jul. 23, 2012 (EP) .................... 12305897

(51) Int. Cl.
| | | |
|---|---|---|
| *C07H 21/04* | (2006.01) | |
| *C12N 15/00* | (2006.01) | |
| *C12N 9/88* | (2006.01) | |
| *C07K 14/235* | (2006.01) | |
| *C07K 14/005* | (2006.01) | |
| *A61K 39/00* | (2006.01) | |

(52) U.S. Cl.
CPC .............. *C12N 9/88* (2013.01); *C07K 14/005* (2013.01); *C07K 14/235* (2013.01); *C12Y 406/01001* (2013.01); *A61K 39/00* (2013.01); *C07K 2319/00* (2013.01); *C07K 2319/40* (2013.01); *C12N 2710/20022* (2013.01); *C12N 2710/20034* (2013.01)

(58) Field of Classification Search
CPC ....................................................... C12N 9/88
See application file for complete search history.

(56) References Cited

U.S. PATENT DOCUMENTS

2007/0072266 A1 3/2007 Preville et al.
2010/0075350 A1* 3/2010 Zegzouti ............... C12Q 1/008
435/8

FOREIGN PATENT DOCUMENTS

| EP | 1 188 446 A1 | 3/2002 |
|---|---|---|
| EP | 1 489 092 A1 | 12/2004 |
| EP | 1576967 B1 | 9/2007 |
| WO | WO 02/22169 A2 | 3/2002 |
| WO | WO 2005/053738 A1 | 6/2005 |
| WO | WO 2005/089792 A1 | 9/2005 |
| WO | WO 2008/025848 A2 | 3/2008 |
| WO | WO 2008/026071 A2 | 3/2008 |
| WO | WO 2012/101112 A1 | 8/2012 |

OTHER PUBLICATIONS

Bauer et al., "Identification of H-2Kb Binding and Immunogenic Peptides from Human Papilloma Virus Tumour Antigens E6 and E7", Scand. J. Immunol., vol. 42 (1995) pp. 317-323.
Bourgault Villada et al., "Identification in humans of HPV-16 E5 and E7 protein epitopes recognized by cytolytic T lymphocytes in association with HLA-B18 and determination of the HLA-B18-specific binding motif", Eur. J. Immunol., vol. 30 (2000) pp. 2281-2289.
Fayolle et al., "Delivery of Multiple Epitopes by Recombinant Detoxified Adentylate Cyclase of Bordetella pertussis Induces Protective Antiviral Immunity", J. of Virology, vol. 75, No. 16 (2001) pp. 7330-7338.
Fayolle et al., "Induction of anti-Tat Neutralizing Antibodies by the CyaA Vector Targeting Dendritic Cells: Influence of the Insertion Site and of the Delivery of Multicopies of the Dominant Tat B-cell Epitope", Vaccine, vol. 28 (2010) pp. 6930-6941.
Gmira et al., "Characterization of recombinant Bordetella pertussis adenylate cyclase toxins carrying passenger proteins", Res. Microbiol., vol. 152 (2001) pp. 889-900.
Hoffmann et al., "T cells specific for HPV16 E7 epitopes in patients with squamous cell carcinoma of the oropharynx", Int. J. Cancer., vol. 118 (2006) pp. 1984-1991.
Holubova et al., "Delivery of Large Heterologous Polypeptides across the Cytoplasmic Membrane of Antigen-Presenting Cells by the Bordetella RTX Hemolysin Moiety Lacking the Adenylyl Cyclase Domain", Infection and Immunity, vol. 80, No. 3, (2012) pp. 1181-1192.
International Search Report issued in International Application No. PCT/EP2013/065546 on Aug. 28, 2013.

(Continued)

*Primary Examiner* — Albert Navarro
(74) *Attorney, Agent, or Firm* — Birch, Stewart, Kolasch & Birch, LLP

(57) ABSTRACT

The invention relates to a chimeric protein comprising or consisting of, from N-terminal to C-terminal, (a) a N-terminal part of a *Bordetella* CyaA protein (b) a heterologous polypeptide, and (c) a C-terminal part of a *Bordetella* CyaA protein. The invention also relates to a polynucleotide encoding a deleted version of a *Bordetella* CyaA, as well as a polynucleotide encoding this chimeric protein. A composition comprising at least one chimeric protein(s) of the invention and the prophylactic and/or therapeutic uses of said composition are also part of the invention.

21 Claims, 20 Drawing Sheets

(56) References Cited

OTHER PUBLICATIONS

International Search Report issued in International Application No. PCT/EP2013/065549 on Oct. 31, 2013.

Karimova et al., "Charge-dependent translocation of Bordetella pertussis adenylate cyclase toxin into eukaryotic cells: Implication for the in vivo delivery of CD8+ T cell epitopes into antigen-presenting cells", Proc. Natl. Acad. Sci., vol. 95 (1998) pp. 12532-12537.

Karst et al., "Identification of a Region that Assists Membrane Insertion and Translocation of the Catalytic Domain of Bordetella pertussis CyaA Toxin", The Journal of Biological Chemistry, vol. 287, No. 12 (2012) pp. 9200-9212.

Preville et al., "Eradication of Established Tumors by Vaccination with Recombinant Bortella pertussis Adenylate Cyclase Carrying the Human Papillomavirus 16 E7 Oncoprotein", Cancer Res., vol. 65, No. 2 (2005) pp. 641-649.

Reinis, "Technology evaluation: HPV vaccine (quadrivalent), Aventis Pasteur MSD/CSL", Current Opinion in Molecular Therapeutics, vol. 6, No. 2 (2004) pp. 206-211.

Sadovnikova et al., "Limitations of predictive motifs revealed by cytotoxic T lymphocyte epitope mapping of the human papilloma virus E7 protein", International Immunology, vol. 6, No. 2 (1993) pp. 289-296.

Clifford et al., "Human Papillomavirus Types in Invasive Cervical Cancer Worldwide: A Meta-analysis," British Journal of Cancer, vol. 88, No. 1, 2003, pp. 63-73.

Genbank, "SEQ ID No. 2 and Alignment of SEQ ID No. 2," Accession No. CAA68613, Jan. 5, 1988, 4 pages.

Munagala et al., "Significance of Multiple HPV Infection in Cervical Cancer Patients and its Impact on Treatment Response," International Journal of Oncology, vol. 34, 2009, pp. 263-271.

U.S. Office Action, issued Jul. 25, 2016, for U.S. Appl. No. 14/416,384.

Guermonprez et al., "In vivo receptor-mediated delivery of a recombinant invasive bacterial toxoid to $CD11c^+CD8^-CD11b^{high}$ dendritic cells", Eur. J. Immunol., vol. 32 (2002) pp. 3071-3081.

Mascarell et al., "Delivery of the HIV-1 Tat protein to dendritic cells by the CyaA vector induces specific Th1 response and high affinity meutralizing antibodies in non human primates", Vaccine. vol. 24 (2006) pp. 3490-3499.

Berraondo et al., "Eradication of Large Tumors in Mice by a Tritherapy Targeting the Innate, Adaptive, and Regulatory Components of the Immune System," Cancer Research, vol. 67, No. 18, Sep. 15, 2007, pp. 8847-8855.

Fayolle et al., "Therapy of Murine Tumors with Recombinant *Bordetella pertussis* Adenylate Cyclase Carrying a Cytotoxic T Cell Epitope", The Journal of Immunology, vol. 162 (1999) pp. 4157-4162.

Schlecht et al., "Antigen Targeting to CD11b Allows Efficient Presentation of $CD4^+$ and $CD8^+T$ Cell Epitopes and In Vivo Th1-Polarized T Cell Priming," The Journal of Immunology, vol. 173, (2004), pp. 6089-6097.

\* cited by examiner

A.

CLUSTAL 2.1 multiple sequence alignment

```
                                                             LXCXE      Acidic
                                                             motif      region
                                                                       ←――――→
gi|30172006|gb|AAP20595.1|        MHGPKATLQDIVLHLEPQNEI--PVDLLCHDQLSDSEEENDEIDGVNHQEL  49
gi|549287|sp|P21736.2|VE7_HPV4    MHGPRETLQEIVLHLEPQNELDFVDLLCYEQLSESEEENDEADGVSHAQL  50
gi|167996747|gb|ACA14208.1        MHGDTPILHEYMLDLQPET----IDLYCYEQLNDSSEEEDEIDG------  40
                                  ***  *::  :*.*:*:.     ..*  *:*:*.:*.**:** **

gi|30172006|gb|AAP20595.1|        PARRAEPQR--HTMLCMCCKCEARIELVVESSADDLRAFQQLFLNTLSFV  97
gi|549287|sp|P21736.2|VE7_HPV4    PARRAEPQR  EKILCVCCKCDGRIELIVESSAEDLRTLQQLFLSTLSFV  98
gi|167996747|gb|ACA14208.1        PAGQAEPDRAHYNIVIFCCKCDSILRLCVQSTHVDIRTLEDLLMGTLGIV  90
                                    *:*    :  :  ****  .*  *:/:  /:*::::*::.**.:* gi|30172006|gb|AAP20595.1|        CPWCASQQ 105
gi|549287|sp|P21736.2|VE7_HPV4    CPWCATXQ 106
gi|167996747|gb|ACA14208.1        CPCSQKP  98
                                  **  *:  :
```

B.

```
                                                             LXCXE      Acidic
                                                             motif      region
                                                                       ←――――→
gi|257472286|gb|ACV53984.1|       MRCHKPTLKEYILDLYPEPTDLYCYEQLSDSSDEDE--GLDRPDGQAQPA  48
gi|19111001|gb|AAL85392.1|AF47    MRCNXPTLREYIIDLHPEPTDLFCYEQLCDSSDEDEI-GLDRPDGQAQPA  49
gi|237861305|gb|ACR24226.1|       MRGDXATIKDYILDLQPETTDLHCYEQLGDSSDEEDTDGVDRPDGQAEQA  50
gi|148727610|gb|ABR08468.1|       MRGETPTLQDYVLDLQPEATDLYCYEQLPDSSDEED  VIDSPAGQAKPD  48
                                  ***...*::*:*** **.**.*****::      :* * ***:

gi|257472286|gb|ACV53984.1|       LADYYIVTCCHTCNTTVRLCVNSTASDLRTIQQLLMGLVNIVCPSCAQL-  97
gi|19111001|gb|AAL85392.1|AF47    LANYYIVTCCYTCDTTVRLCLNSTTTVRTLQQLLMGLCTIVCPSCAQQ-  98
gi|237861305|gb|ACR24226.1|       TSNYYIVTYCHSQDSTIRLCTFSTATIERFLQQMLTGTLQVVCPGCARL-  99
gi|148727610|gb|ABR08468.1|       ISNYXIVTFCCQGESTLRLCVQSTQVDIRILQELLMISFGIVCPNCSTRL 98
                                  *:*.*** *::*:****:**  **.   *: :*:::*:    :*: ***:
```

| HPV16 E7 Cter | HPV18 E7 Cter | HPV45 E7 Cter | HPV16 E7 Nter | HPV18 E7 Nter | HPV45 E7 Nter |

B.

| HPV31 E7 Cter | HPV33 E7 Cter | HPV52 E7 Cter | HPV58 E7 Nter | HPV31 E7 Nter | HPV33 E7 Nter | HPV52 E7 Nter | HPV58 E7 Nter |

Fig. 8

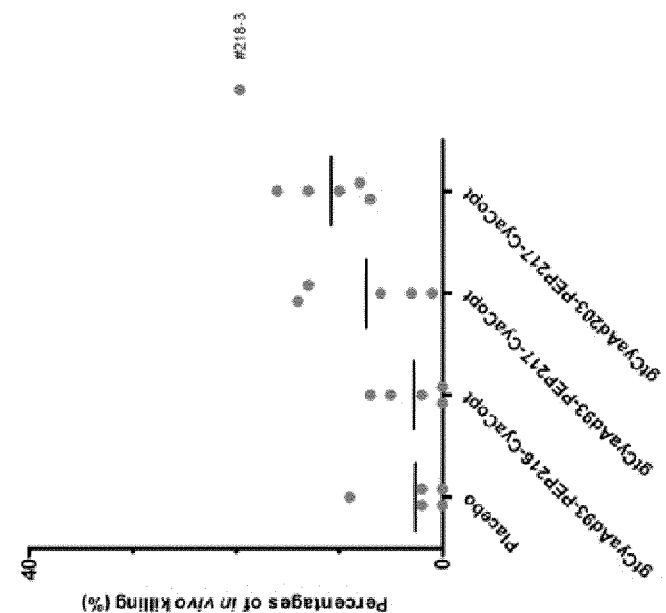
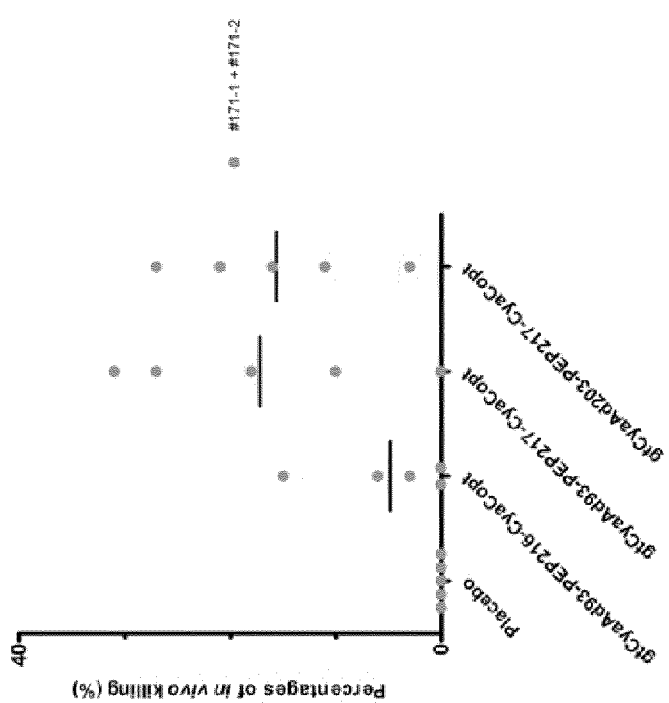
Fig. 12

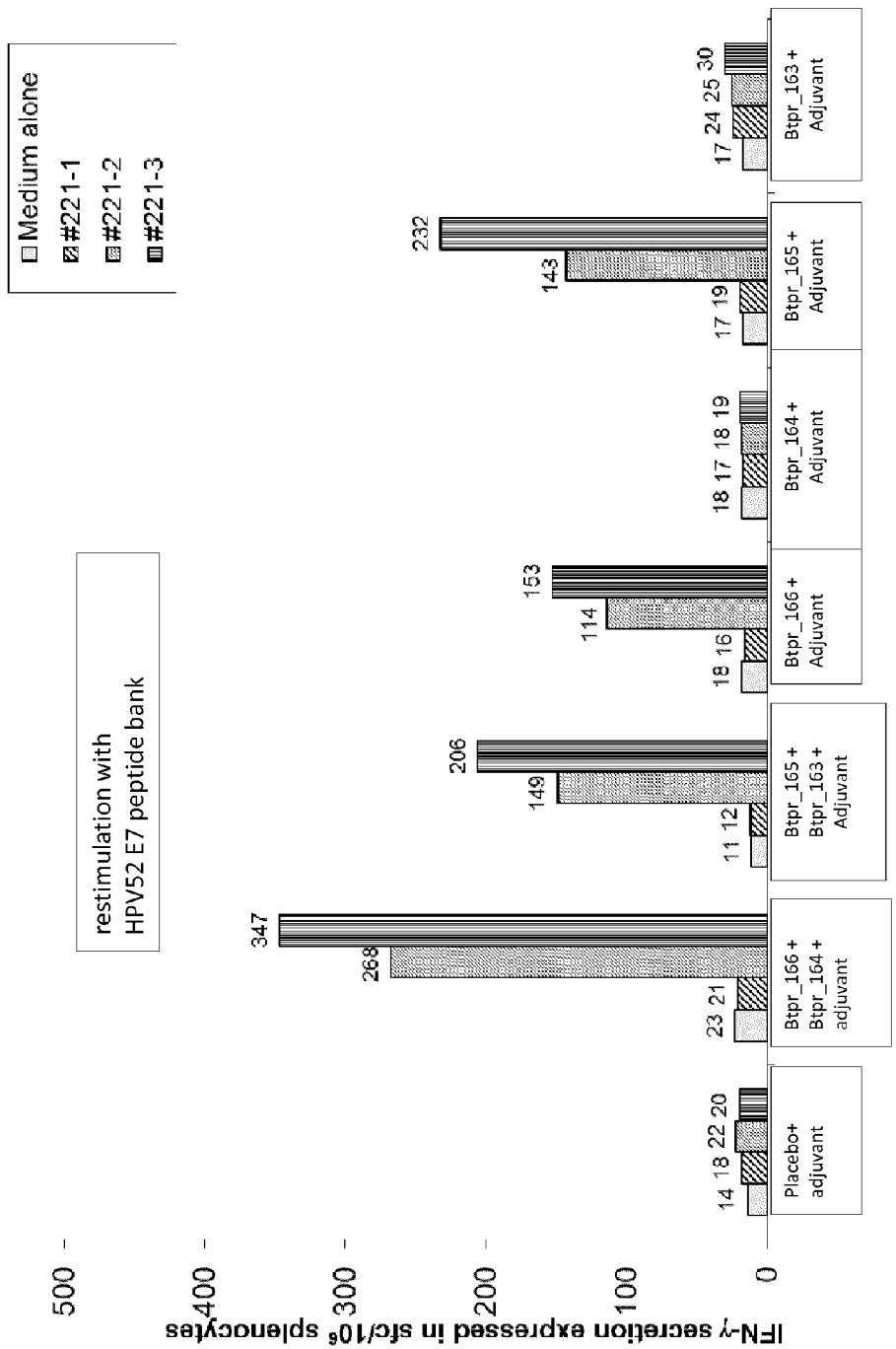

CYAA-BASED CHIMERIC PROTEINS COMPRISING A HETEROLOGOUS POLYPEPTIDE AND THEIR USES IN THE INDUCTION OF IMMUNE RESPONSES

FIELD OF THE INVENTION

The invention relates to a chimeric protein comprising or consisting of, from N-terminal to C-terminal, (a) a N-terminal part of a *Bordetella* CyaA protein (b) a heterologous polypeptide, and (c) a C-terminal part of a *Bordetella* CyaA protein. The invention also relates to a polynucleotide encoding a deleted version of a *Bordetella* CyaA, as well as a polynucleotide encoding this chimeric protein. A composition comprising at least one chimeric protein(s) of the invention and the prophylactic and/or therapeutic uses of said composition are also part of the invention.

BACKGROUND OF THE INVENTION

The Adenylate Cyclase (CyaA) of *Bordetella* types in particular of *Bordetella pertussis*, has been described extensively as a recombinant vector able to deliver efficiently polypeptides, such as antigens, into the cytosol of antigen-presenting cells (APC) [1], [2], [3]. More, recombinant CyaAs have been used to efficaciously treat mice that bear tumours [4], [5], [6].

Several authors have highlighted that the efficiency of polypeptide-delivery, in particular antigen-delivery, by CyaA (used as a vector) can be positively or negatively affected by electrostatic charge of the inserted polypeptide (antigen) and its conformation. In 1998, Karimova & al. [7] described that the delivery of CD8+ T-cell polypeptide epitopes, inserted in CyaA, to and into antigen-presenting cells was dependent on the electrostatic charge of the inserted epitopes: a recombinant CyaA harbouring the OVA epitope was able to translocate into APC and to induce a CTL response in vivo, while the same construct with 4 glutamic residues fused to the OVA epitope, could no more translocate, and did not induce a detectable Cytotoxic T-cell Lymphocyte (CTL) response in vivo. In 2012, Holubova et al. described various constructs based on CyaA: either CyaA proteins deleted within their N-terminal comprising the OVA epitope SIINFEKL, or CyaA proteins truncated for their N-terminal domain and comprising several epitopes inserted at different sites [25]. Holubova et al. concludes that their experiments provide a proof of concept for construction of CyaA-based antigen delivery having the entire AC domain replaced by large artificial CTL polyepitope.

In 2001, Gmira & al. [8] developed a new CyaA vector to facilitate construction of recombinant CyaAs with exogenous polypeptides or antigens inserted within their catalytic domains. These modifications were:
- the insertion of a multi-cloning site sequence with new unique restriction sites downstream from codon 224;
- the deletion of codons 225 to 234; and
- the change of codons 236, 238 and 239; these modifications were introduced to increase the local electrostatic charge (less acidic), which was previously shown to be critical for translocation of this CyaA-antigen hybrid protein across the cellular membrane of in situ APC.

The modified CyaA had similar invasive activity as the wild type CyaA.

The authors have tested 5 antigens, whose size range from 87 to 206 residues, with an electrostatic charge from −4 to +14, and showed that those having an acidic value had lost their translocation efficiency, confirming previous results from Karimova et al. Moreover, they tested CyaAs with antigens with internal disulphide bridges or complex structures: none was able to translocate into the targeted cells, supporting the hypothesis that the polypeptides inserted in the catalytic domain of CyaA must unfold in order to be translocated.

TABLE 1 extracted from [7] and [8]. Inserts with an acidic charge are not translocated into the cytosol of APCs. The acidic charge is calculated from the number of Lys and Arg residues minus the number of Asp and Glu residues.

| References | rCyaA | antigen name/ origin | Antigen size (aa) | Antigen electro-static charge (R/K-D/E) | Activity (+ or −) |
|---|---|---|---|---|---|
| Gmira et al., 2001 | CyaA | None | NA | NA | + |
| | CyaA-Neuro | Bovine neurocalcine δ | 192 | −6 | − |
| | CyaA-Rest | *Aspergillus restrictus* restrictocin | 148 | 5 | + |
| | CyaA-DHFR | Mouse Dihydrofolate reductase | 187 | 7 | + |
| Karimova et al., 1998 | CyaA-Tat | Tat HIV | 87 | 14 | + |
| | CyaA-Nef | Nef HIV | 206 | −4 | − |
| | CyaA-Ova21 | Ova class I epitope | 8 | 0 | + |
| | CyaA-Ova21-4E | Ova class I epitope + 4 glutamic acids | 12 | −4 | − |

The antigens used in the case of tumour regression assays had either a short size (OVA is 8 residues in length) [4] or their secondary structure was disrupted by internal rearrangements of antigen segments and with a maximal size of 103 residues [5].

From these studies, the following conclusions to improve efficiency of vectorisation by the CyaA vector have been drawn:
- Inclusion of acid regions in a polypeptide to be inserted into CyaA should be avoided; and
- Inclusion of secondary and tertiary structures in these inserts should be avoided because such structures interfere with proper internalization of the enzymatic adenylate cyclase (AC) domain in which the polypeptide has been inserted.

In view of these conclusions, two recombinant CyaAs were constructed one containing the HPV16 E7 antigen and the other one the HPV18 E7 antigen. In addition a bivalent recombinant CyaA was also constructed in which the HPV16 and HPV18 E7 antigens have been inserted together (patent EP1576967; Préville et al.). However, no assay was reported with a recombinant CyaA into which more than 2 HPV E7 proteins have been inserted into the same CyaA vector.

Thus, Préville and al. discloses three recombinant CyaA vectors into which the E7 polypeptide of the HPV16 type or variants thereof has been inserted.
- the CyaA-E7$^{full}$ vector, containing the E7 protein full length,
- the CyaA-E7$_{\Delta 30\text{-}42}$ vector, containing E7 fragments deleted from the acidic domain from aa 30 to 42
- the CyaA-E7$_{49\text{-}57}$ vector, containing a murine H-2D$^b$-restricted T cell epitope present on E7.

These recombinant CyaA vectors were used to immunize mice and to detect E7-specific CTL responses. To measure the immune response after mice immunisation, CTL Chrome Release assays were performed. In in vivo animal experiments, CyaA-E7$_{\Delta30\text{-}42}$ and CyaA-E7$^{full}$ gave the most efficient CTL immune response compared to CyaA-E7$_{49\text{-}57}$ The ability of these recombinant CyaA vectors to induce tumour regression was also evaluated. If the rate of tumour regression conferred by CyaA-E7$_{49\text{-}57}$ and CyaA-E7$^{full}$ could not be noticeably differentiated, CyaA-E7$_{\Delta30\text{-}42}$ was clearly superior in terms of tumour regression and growth inhibition. Thus, the single CTL epitope previously shown to be recognized in C57BL/6 mice has been proved to be efficient, but did not give the most optimal immune response.

The persistence of the immune response was then tested. Splenocytes from some surviving mice after 3 months were tested for their ability to lyse TC-1 cells expressing the E7 antigen and the other surviving animals were re-challenged with TC-1 cells at day 100 post vaccination. Animals vaccinated with CyaA-E7$_{\Delta30\text{-}42}$ displayed a high level of protection. Less than 40% of animals vaccinated with CyaA-E7$_{49\text{-}57}$ were protected while 90% to 100% of animals vaccinated with CyaA-E7$_{\Delta30\text{-}42}$ and CyaA-E7$^{full}$ survived.

The following teachings can be extracted from this work:
CyaA vectors carrying HPV16 and/or HPV18 E7 proteins lead to an immune response in C57BL/6 mice;
a complete response is obtained with an antigen having both its CD8$^+$ and CD4$^+$ T cell epitopes, as compared to the E7$_{49\text{-}57}$ epitope which has a CD8$^+$ T cell epitope only;
a superior efficiency is obtained in mice treated with the CyaA-E7$_{\Delta30\text{-}42}$ vector where the E7 protein is deleted of its acidic region from residues 30 to 42, as compared to mice treated with CyaA-E7$^{full}$ or CyaA-E7$_{49\text{-}57}$;
the immune response obtained with these vectors is able to induce regression of tumour lesions;
a long lasting response is obtained, since a new challenge with TC-1 cells, in treated tumour free mice, is rejected; and
the co-injection of two recombinant CyaAs in order to develop a bivalent therapy is possible, each antigen keeping the response against its epitopes respectively.

Therefore, in the prior art, acidic amino acid stretches embedded in certain polypeptides or antigens and overall negatively charged polypeptides or antigens have been shown to alter the efficiency of a CyaA vector to translocate these polypeptides, across the cell membrane of APC in vaccinated animals. This leads to weak or no protective cellular immune responses against said antigens.

The inventors consider that this may be regarded as a drawback for the design of drug candidates, since such acidic amino acid sequences may contain important CD4$^+$ epitopes and/or CD8$^+$ epitopes, required for protective cellular immunity.

Therefore, there is still a need for improved vectors bearing immunogenic constructions which can be used to induce strong and long lasting cellular protective immune responses, in particular in tumour regression and tumour prevention, against polypeptides and antigens encompassing acidic amino acid stretches and against overall negatively charged polypeptides or antigen.

BRIEF DESCRIPTION OF THE DRAWINGS

FIG. 7: (A) Alignment of HPV16, 18 and 45 E7 protein sequences; black box: the pRB binding motif; grey boxes: the cysteines implicated in the Zinc-finger loop; the black arrow highlights the acidic region (B) Alignment of HPV31, 33, 52 and 58 protein sequences; black box: LXCXE motif; green boxes: Cysteines implicated in the Zinc-finger loop; dotted line box: for HPV52 E7 sequence, position of the auto-immune epitope.

FIG. 8: (A) Trivalent candidate vaccines antigens (B) Reshuffled antigen sequences of tetravalent candidate vaccines (N-ter: N-terminal part of the E7 protein; C-ter: C-terminal part of the E7 protein).

Total splenocytes were restimulated with 15-mers overlapping peptides covering HPV45 E7 full peptide sequence (sub-pool 1: #218-1, sub-pool 2: #218-2, sub-pool 3: #218-3). Results are expressed as number of cells that secreted IFN-γ per million of total splenocytes.

FIG. 12: In vivo killing assay with trivalent candidates (Btpr_114, Btpr115 & BTpr_117); left panel: percentage of in vivo killing of splenocytes loaded with HPV18 E7 peptide libraries #171-1 and #171-2; right panel: percentage of in vivo killing of splenocytes loaded with HPV45 E7 peptide library #218-3.

Figure 13:
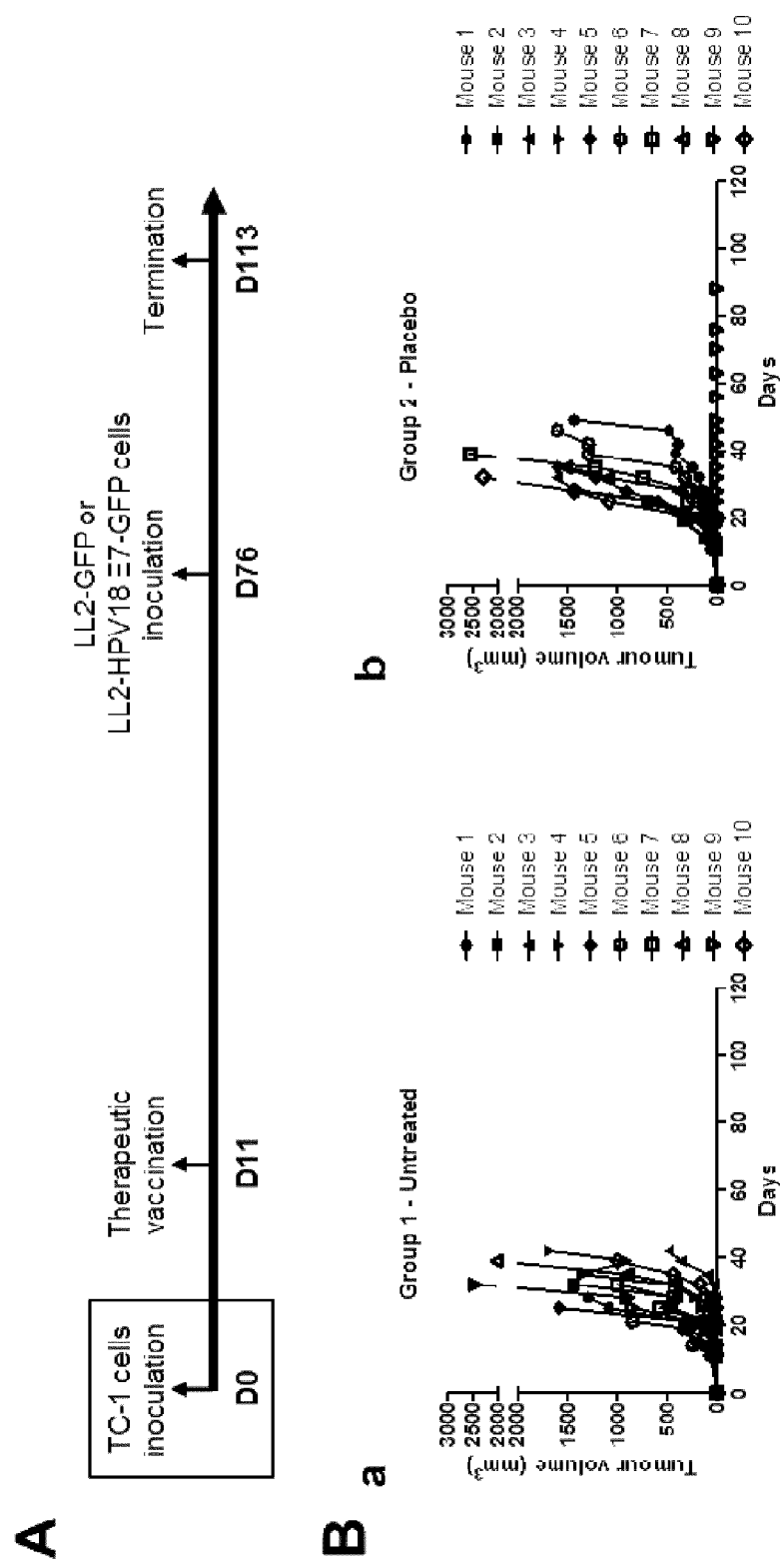
Figure 13:
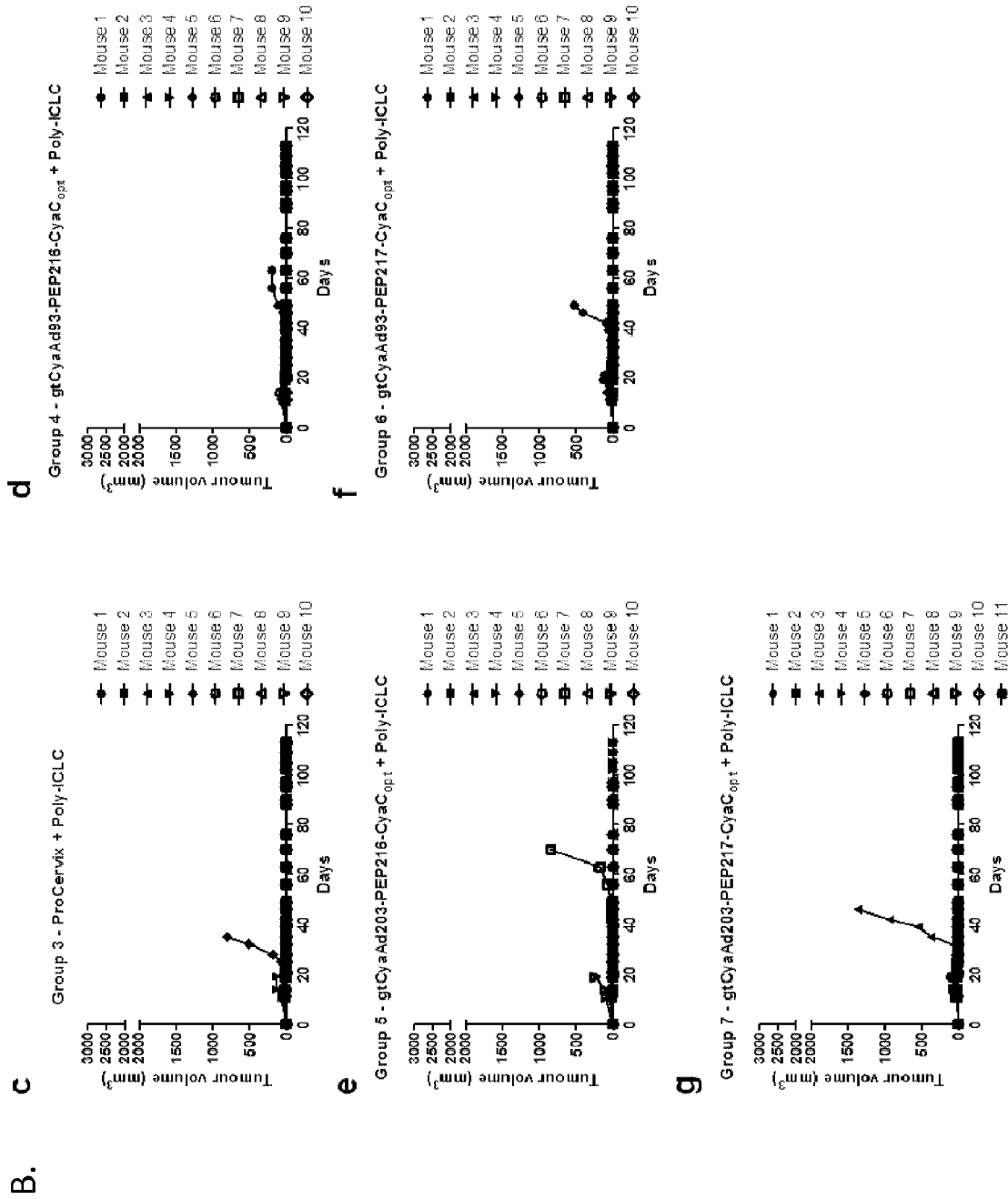

FIG. 13: Therapeutic vaccination by Poly-ICLC-adjuvanted CyaA-candidate vaccines embedding the HPV16 E7 antigen lead to TC-1 induced solid tumour clearance; (A) Vaccination scheme: all mice were inoculated on the right flank at day 0 with TC-1 tumour cells; they were treated at day 11. (B) Monitoring of tumour growth until day 60.

Figure 14:
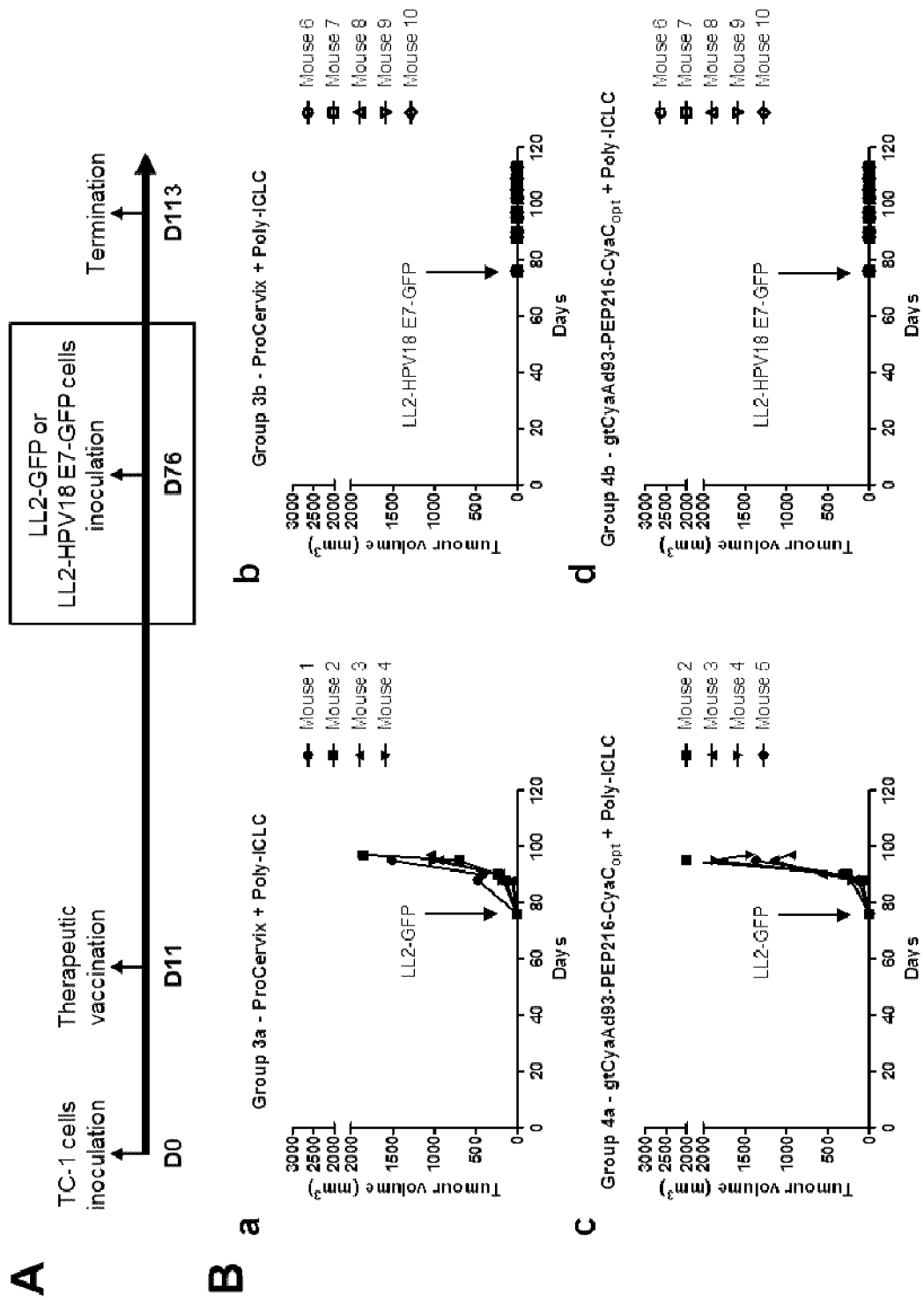
Figure 14:
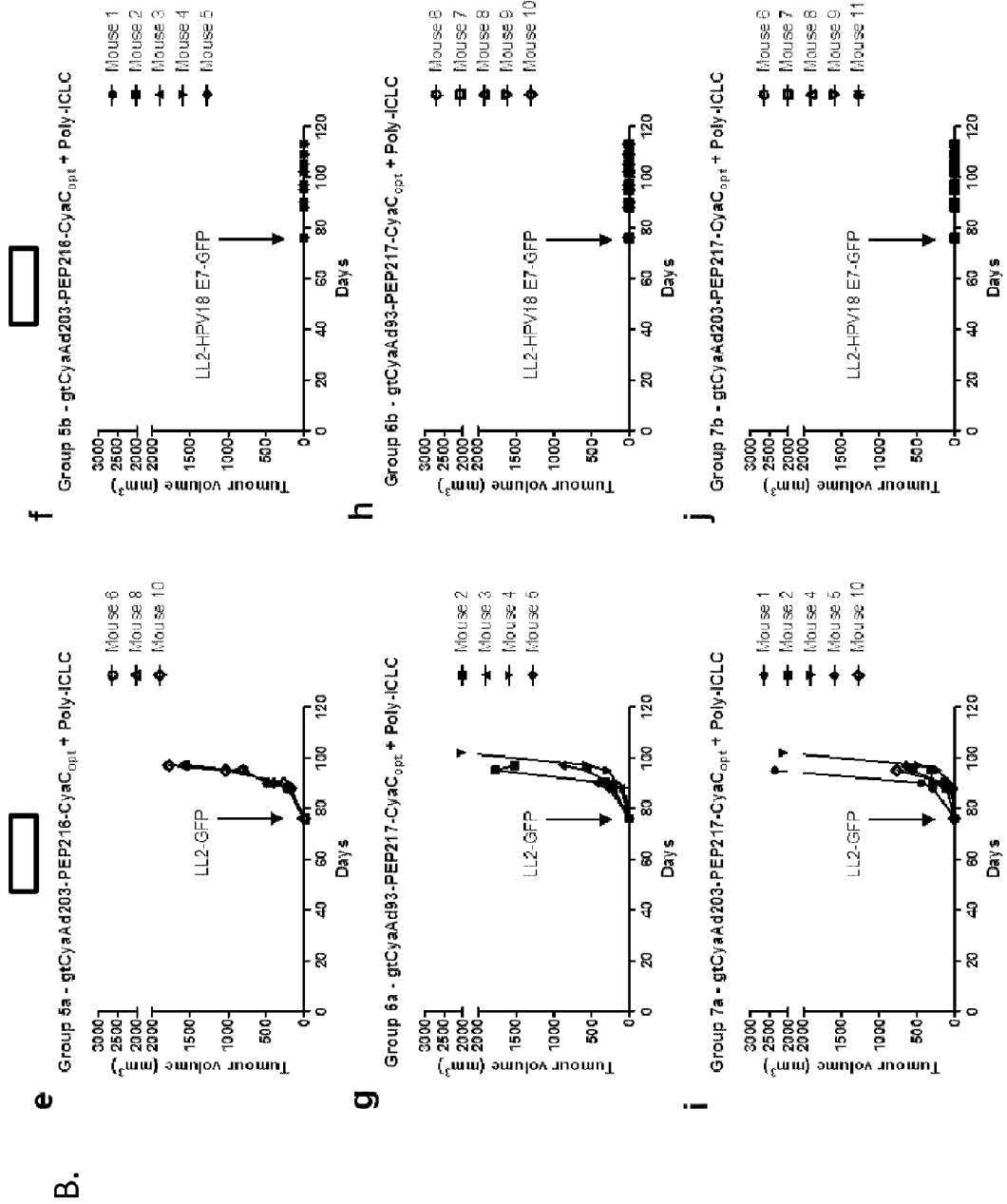

FIG. 14: Prophylactic protection of mice that cleared the TC-1 tumour cell line against the growth of LL2-HPV18 E7 cell line or of LL2-GFP cell line (A) Vaccination schema: at day 65, mice that have cleared the TC-1 tumours were divided in two sub-groups and were inoculated either with LL2-HPV18 E7 cell line or with the control LL2-GFP cell line. (B) Monitoring of tumour growth until day 110.

Figure 15:
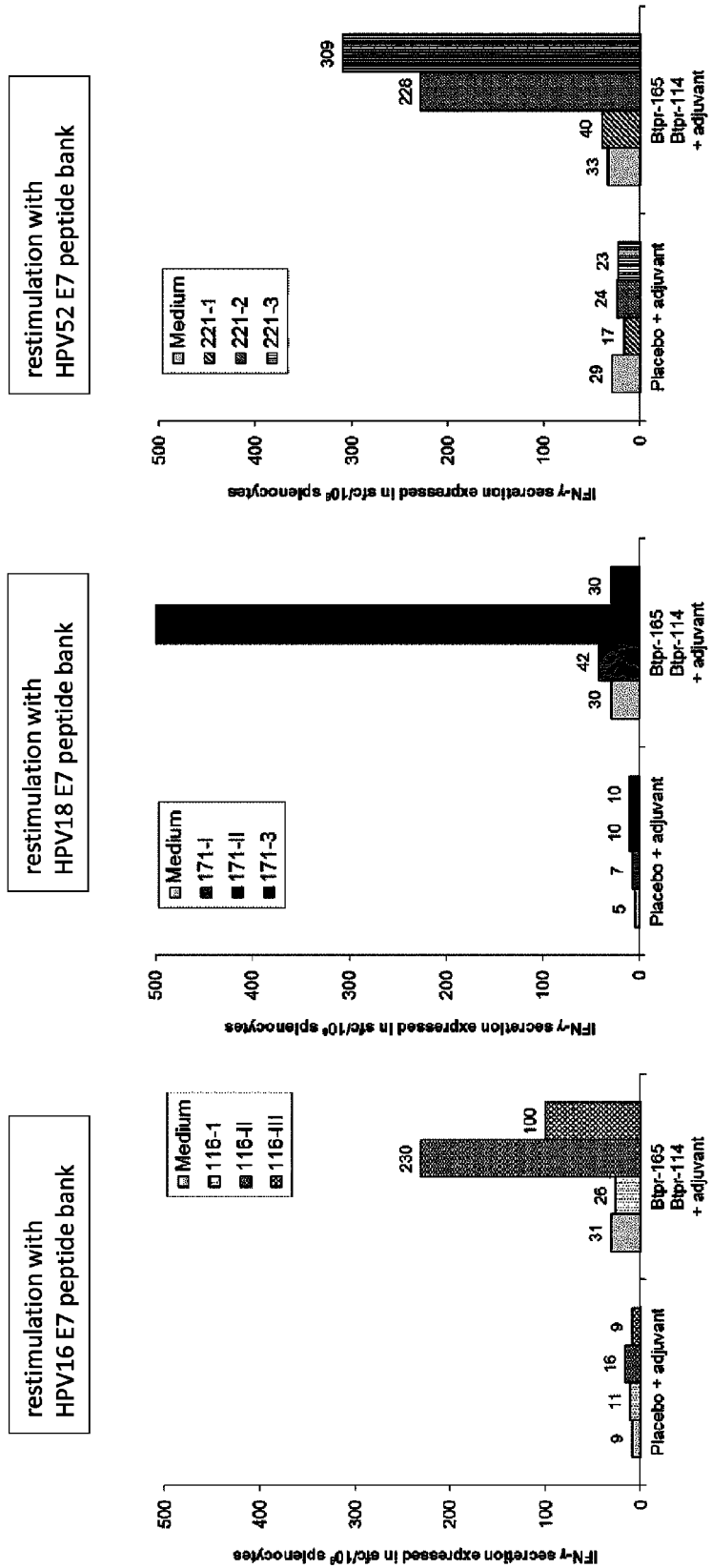

FIG. 15: Frequencies of HPV16 E7, HPV18 E7 and HPV52 E7 specific T lymphocytes measured seven days post-immunisation—Total splenocytes were restimulated with 15-mers overlapping peptides covering HPV16, HPV18 and HPV52 E7 protein sequences. Sub-pools of peptides are indicated in the squares. Results are expressed as number of IFN-γ spots forming cells (sfc) per million of total splenocytes. HPV18 E7 sfc were too numerous to count (TNTC).

Figure 16:
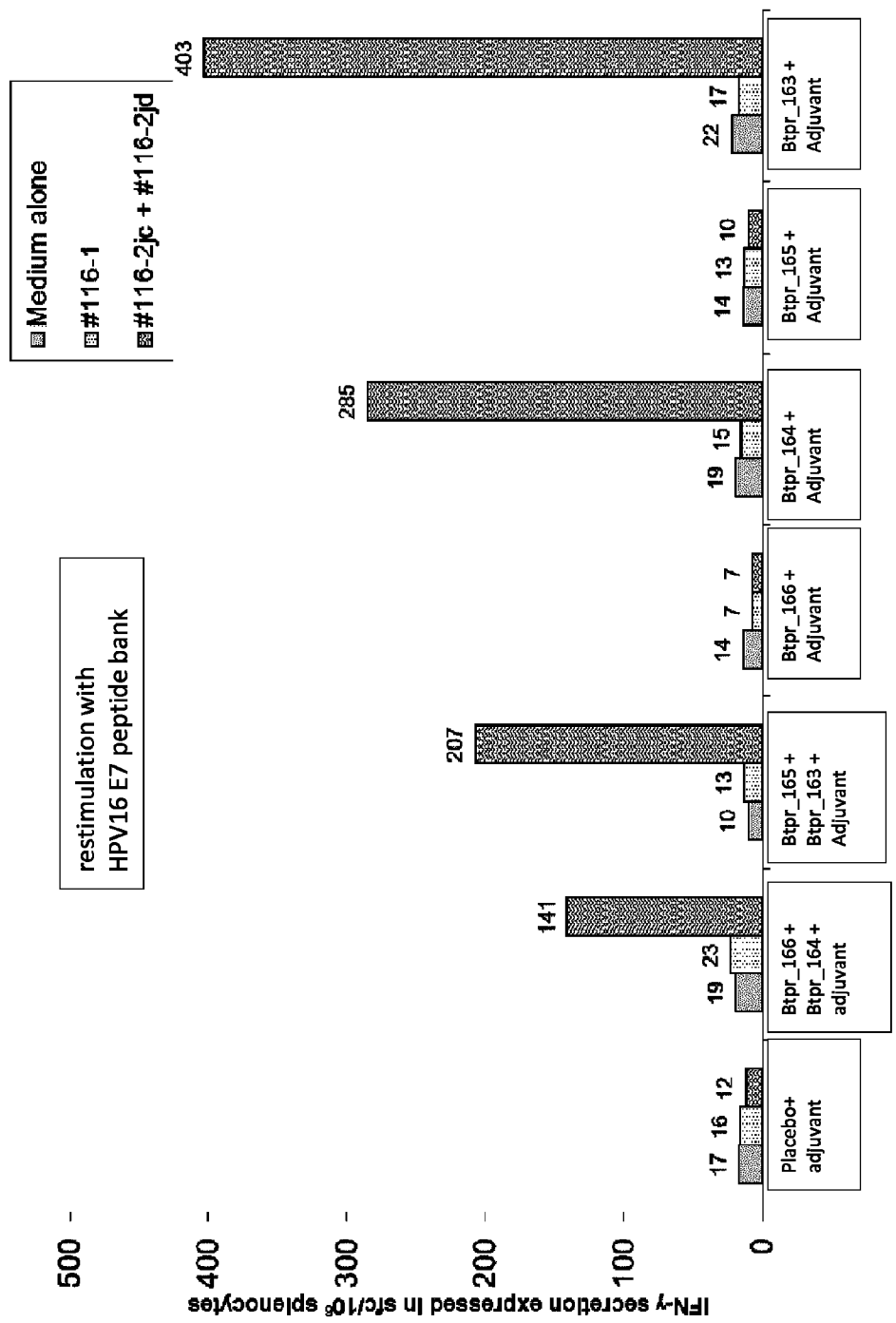
Figure 16:
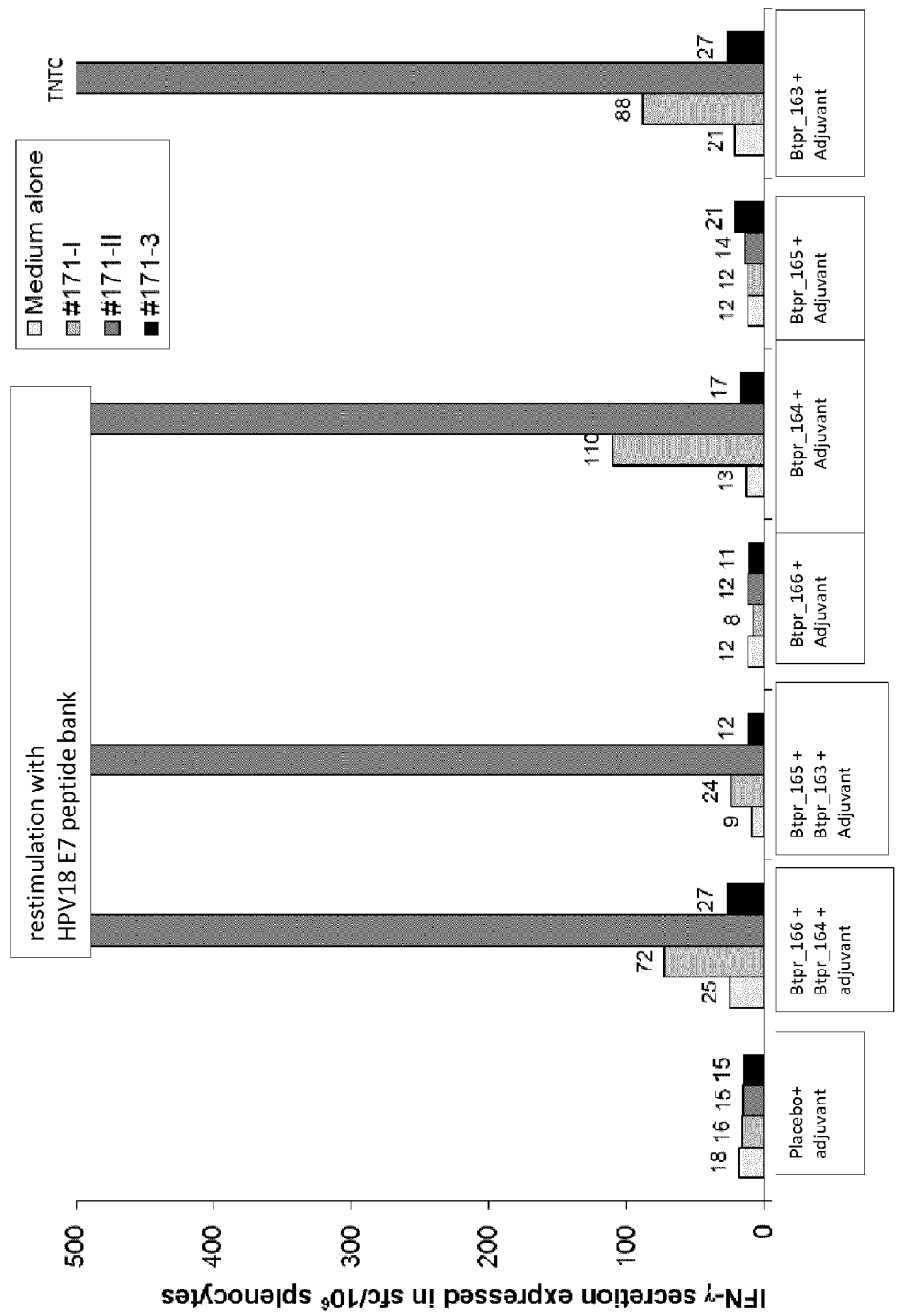
Figure 16:
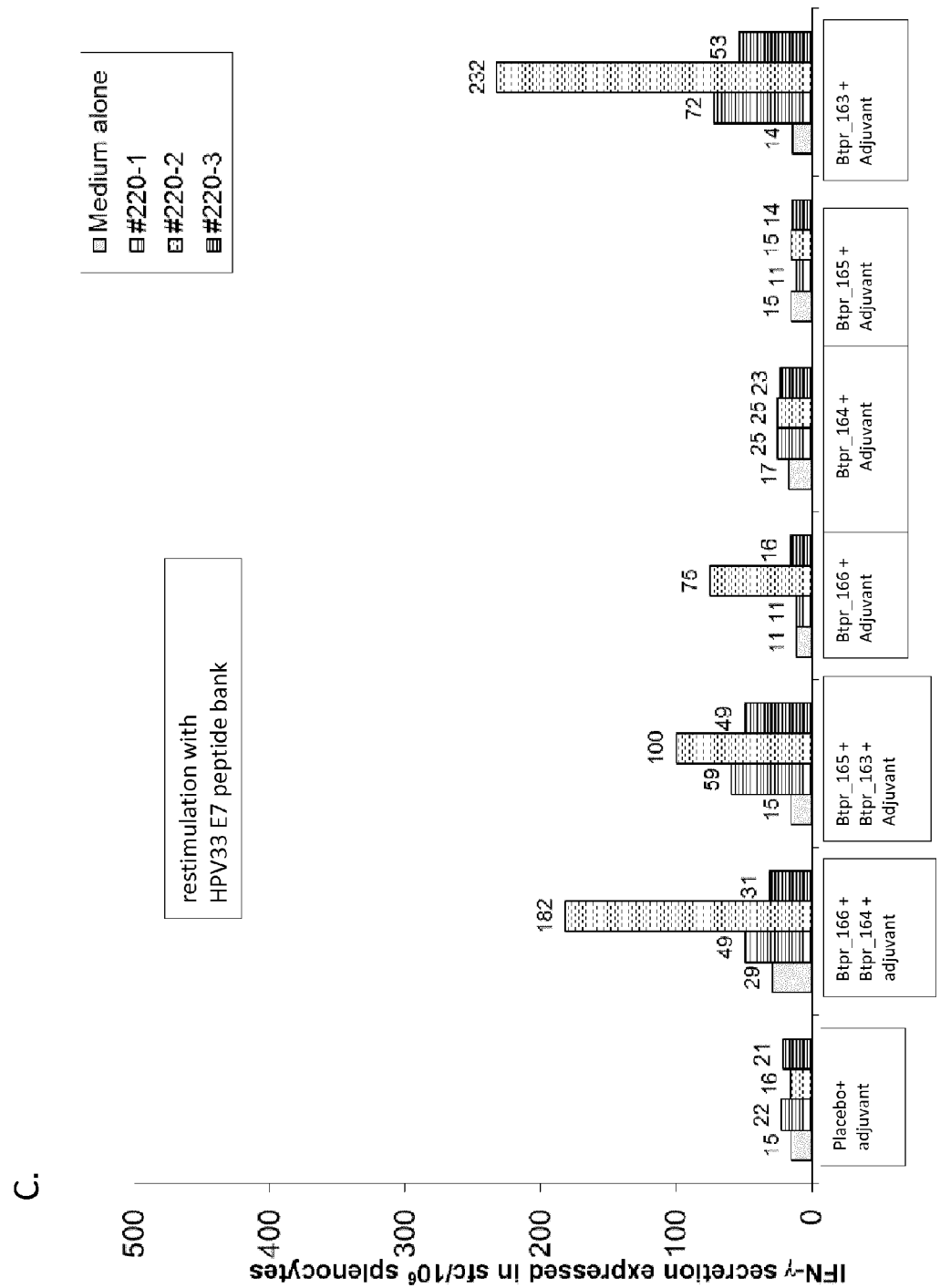

FIG. 16 (A, B, C, et D): Frequencies of IFN-γ secreting HPV16 E7, HPV18 E7, HPV33 E7 and HPV52 E7 specific T lymphocytes measured seven days post-immunisation. Total splenocytes were restimulated with 15-mers overlapping peptides covering HPV16, HPV18, HPV33 and HPV52 E7 full peptide sequences (each peptide bank is subdivided in sub-pools from the N-terminal to the C-terminal of the E7 protein (as indicated in histograms legends). Results are expressed as number of IFN-γ spots forming cells per million of total splenocytes.

Figure 17:
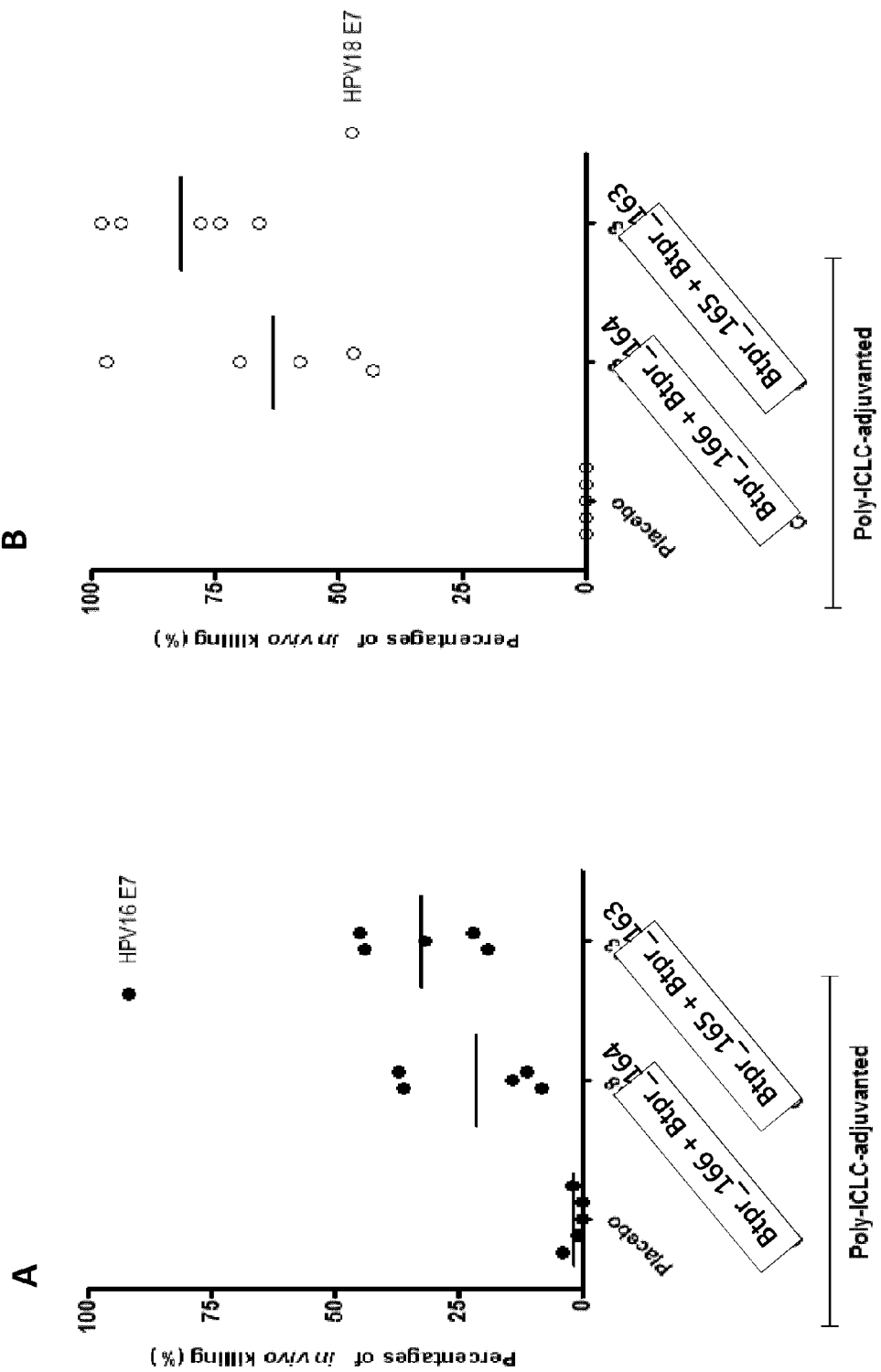

FIG. 17 (A and B): E7-specific killing of cells loaded respectively with HPV16 E7 peptide library (FIG. 17-A) or HPV18 E7 peptide library (FIG. 17-B) induced by heptavalent candidate vaccines.

DETAILED DESCRIPTION

The present inventors have developed new CyaA vectors which have been deleted in the adenylate cyclase (AC) domain of the wild type CyaA, and into which antigens of large size (illustrated with sequences having up to 441 amino acid residues but no limited thereto) and/or presenting highly negative electrostatic charges also designated as acidic charges (up to −46) have been inserted. The capacity of these constructs to induce specific CD8+ and CD4+ T-cell responses and cytotoxicity as well as their capacity to induce tumour rejections has been tested. Surprisingly, these new CyaA vectors have been shown to allow the delivery of antigens with high negative electrostatic charge to target cells. Moreover, when inserted into these new vectors, antigens with their acidic domain were more efficient, in cytotoxic assays performed under stringent conditions, as compared to the same antigens deprived of these acidic domains.

The invention is directed to a polynucleotide encoding a CyaA-derived protein, wherein said CyaA-derived protein comprises or consists of:

1) a fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2 (i.e., between positions 182 and 228), fused to 2) a fragment of the *Bordetella pertussis* CyaA protein as set forth in SEQ ID NO: 2, the sequence of said fragment beginning with a residue located from position 321 to position 387 of SEQ ID NO:2 (i.e., between positions 320 and 388) and ending with the last residue of SEQ ID NO:2.

SEQ ID NO: 2 represents the amino acid sequence of the wild type CyaA protein of *Bordetella pertussis*. A particular embodiment of a polynucleotide, encoding the CyaA as set forth in SEQ ID NO: 2, is as set forth in SEQ ID NO:1. Another particular embodiment of a polynucleotide, encoding the CyaA as set forth in SEQ ID NO: 2, is a modified version of sequence SEQ ID NO:1, by silent nucleotide mutations, i.e., by modifications which do not result in a change to the amino acid of SEQ ID NO:2. A particular modified version of SEQ ID NO:1 is a sequence, optimized for in expression *E. coli*, as set forth in SEQ ID NO:69. SEQ ID NO:69 is part of the invention. Within the present invention, a polynucleotide encoding a CyaA-derived protein of the invention does not encode or does not comprise a polynucleotide encoding SEQ ID NO:2. Moreover, a polynucleotide encoding a CyaA-derived protein of the invention does not comprise or does not consist of SEQ ID NO:1.

The resulting CyaA-derived protein of the invention obtainable from said polynucleotide of the invention comprises or consists of two fragments, fused together or recombined, of the same *Bordetella* CyaA protein. By "fragment", it is meant a stretch or a concatenation of consecutive amino acid residues found in the sequence of the wild type *Bordetella* CyaA protein.

The first fragment (the N-terminal portion of the CyaA-derived polypeptide) begins with the first residue of SEQ ID NO:2 and ends with a residue located from position 183 to position 227 of SEQ ID NO:2.

This first fragment has a size ranging from 183 to 227 residues, i.e., is at least 183 residues and is at most 227 residues in length. In a particular embodiment, this fragment is at least 183, at least 190, at least 200, at least 210 or at least 220. In a particular embodiment, the size of this first fragment is 183 residues or is 227 residues.

Thus, this fragment begins with the first residue of SEQ ID NO:2 and ends with a residue selected from the group consisting of residues 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226 and 227 of SEQ ID NO: 2.

In other words, this first fragment comprises or consists of a sequence which is selected from the group consisting of residues 1-183, 1-184, 1-185, 1-186, 1-187, 1-188, 1-189, 1-190, 1-191, 1-192, 1-193, 1-194, 1-195, 1-196, 1-197, 1-198, 1-199, 1-200, 1-201, 1-202, 1-203, 1-204, 1-205, 1-206, 1-207, 1-208, 1-209, 1-210, 1-211, 1-212, 1-213, 1-214, 1-215, 1-216, 1-217, 1-218, 1-219, 1-220, 1-221, 1-222, 1-223, 1-224, 1-225, 1-226 and 1-227 of SEQ ID NO: 2.

In a particular embodiment, this first fragment comprises or consists of residues 1 to 227 of SEQ ID NO:2 or of residues 1 to 183 of SEQ ID NO:2.

In a particular embodiment, the polynucleotide encoding said first fragment begins with the first nucleotide of SEQ ID NO:1 or of SEQ ID NO:69 and ends with a nucleotide located from position 549 to position 681 of SEQ ID NO:1 or of SEQ ID NO:69, provided that the length of said nucleotide fragment is a multiple of 3. Thus, the polynucleotide encoding this fragment comprises or consists of a sequence which is selected from the group consisting of residues 1-549, 1-552, 1-555, 1-558, 1-561, 1-564, 1-567, 1-570, 1-573, 1-576, 1-579, 1-582, 1-585, 1-588, 1-591, 1-594, 1-597, 1-600, 1-603, 1-606, 1-609, 1-612, 1-615, 1-618, 1-621, 1-624, 1-627, 1-630, 1-633, 1-636, 1-639, 1-642, 1-645, 1-648, 1-651, 1-654, 1-657, 1-660, 1-663, 1-666, 1-669, 1-672, 1-675, 1-678 and 1-681 of SEQ ID NO:1 or of SEQ ID NO:69.

The second fragment (the C-terminal portion of the CyaA-derived polypeptide) begins with a residue located from position 321 to position 387 of SEQ ID NO:2 and ends with the last residue of SEQ ID NO:2.

This second fragment has a size ranging from 1320 to 1386 residues, i.e., is at least 1320 residues and is at most 1386 residues in length. In a particular embodiment, this fragment is at least 1320, at least 1330, at least 1340, at least 1350, at least 1360, at least 1370 or at least 1380. In a particular embodiment, the size of this second fragment is 1320 residues or is 1386 residues.

Thus, this second fragment begins with a residue selected from the group consisting of residues 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386 and 387 of SEQ ID NO:2 and ends with the last residue (i.e., residue 1706) of SEQ ID NO:2.

In other words, this second fragment comprises or consists of a sequence which is selected from the group consisting of residues 321-1706, 322-1706, 323-1706, 324-1706, 325-1706, 326-1706, 327-1706, 328-1706, 329-1706, 330-1706, 331-1706, 332-1706, 333-1706, 334-1706, 335-1706, 336-1706, 337-1706, 338-1706, 339-1706, 340-1706, 341-1706, 342-1706, 343-1706, 344-1706, 345-1706, 346-1706, 347-1706, 348-1706, 349-1706, 350-1706, 351-1706, 352-1706, 353-1706, 354-1706, 355-1706, 356-1706, 357-1706, 358-1706, 359-1706, 360-1706, 361-1706, 362-1706, 363-1706, 364-1706, 365-1706, 366-1706, 367-1706, 368-1706, 369-1706, 370-1706, 371-1706, 372-1706, 373-1706, 374-1706, 375-1706, 376-1706, 377-1706, 378-1706, 379-1706, 380-1706, 381-1706, 382-1706, 383-1706, 384-1706, 385-1706, 386-1706 and 387-1706 of SEQ ID NO:2 In a particular embodiment, this second fragment comprises or consists of residues 321-1706 of SEQ ID NO:2 or of residues 387-1076 of SEQ ID NO:2.

In a particular embodiment, the polynucleotide encoding said second fragment begins with a nucleotide located from position 961 to position 1159 of SEQ ID NO:1 or of SEQ ID NO:69 and ends with the last nucleotide (i.e., nucleotide 5118) of SEQ ID NO:1 or of SEQ ID NO:69, provided that the length of said nucleotide fragment is a multiple of 3. Thus, the polynucleotide encoding this second fragment comprises or consist of a sequence which is selected from the group consisting of residues 961-5118, 964-5118, 967-5118, 970-5118, 973-5118, 976-5118, 979-5118, 982-5118, 985-5118, 988-5118, 991-5118, 994-5118, 997-5118, 1000-5118, 1003-5118, 1006-5118, 1009-5118, 1012-5118, 1015-5118, 1018-5118, 1021-5118, 1024-5118, 1027-5118, 1030-5118, 1033-5118, 1036-5118, 1039-5118, 1042-5118, 1045-5118, 1048-5118, 1051-5118, 1054-5118, 1057-5118, 1060-5118, 1063-5118, 1066-5118, 1069-5118, 1072-5118, 1075-5118, 1078-5118, 1081-5118, 1084-5118, 1087-5118, 1090-5118, 1093-5118, 1096-5118, 1099-5118, 1102-5118, 1105-5118, 1108-5118, 1111-5118, 1114-5118, 1117-5118, 1120-5118, 1123-5118, 1126-5118, 1129-5118, 1132-5118, 1135-5118, 1138-5118, 1141-5118, 1144-5118, 1147-5118, 1150-5118, 1153-5118, 1156-5118 and 1159-5118 of SEQ ID NO:1 or of SEQ ID NO:69.

In a particular embodiment, the CyaA-derived protein comprises or consists a polypeptide of the sequence as set forth in SEQ ID NO:10; SEQ ID NO:10 consists of a fragment consisting of residues 1 to 227 of SEQ ID NO:2 fused to a fragment consisting of residues 321 to 1706 of SEQ ID NO:2.

In another particular embodiment, the CyaA-derived protein comprises or consists of a polypeptide of the sequence as set forth in SEQ ID NO:12; SEQ ID NO:12 consists of a fragment consisting of residues 1 to 183 of SEQ ID NO:2 fused to a fragment consisting of residues 387 to 1706 of SEQ ID NO:2.

Other particular embodiments are also disclosed:
the CyaA-derived protein comprises or consists of a polypeptide of the sequence as set forth in SEQ ID NO:19, i.e., a sequence consisting a fragment consisting of residues 1 to 227 of SEQ ID NO:2 fused to a fragment consisting of residues 387 to 1706 of SEQ ID NO:2, and
the CyaA-derived protein comprises or consists of a polypeptide of the sequence as set forth in SEQ ID NO:20, i.e., a sequence consisting of a fragment consisting of residues 1 to 183 of SEQ ID NO:2 fused to a fragment consisting of residues 321 to 1706 of SEQ ID NO:2.

The expression "fused to" when reference is made to a protein or a polypeptide means that each peptide part (e.g., several CyaA fragments, and optionally a heterologous polypeptide) are covalently linked together by a peptide bond. The order of these different peptide parts is described herein as from N-terminal to C-terminal, i.e., the last C-terminal residue of a part is linked to the first N-residue of the other part by a peptide bond. The expression "fused to" when reference is made to a polynucleotide, means that two or more polynucleotide parts (e.g., several nucleotide CyaA fragments, and optionally a nucleotide encoding a heterologous polypeptide) are covalently linked together by a phosphodiester bond. The order of these different nucleotide parts is described herein as from 5' to 3', i.e., the last 3' nucleotide of a part is linked to the first 5' nucleotide of the other part by a phosphodiester bond. The polynucleotide consisting of the fusion of nucleotide sequences is in particular obtained as a recombinant polynucleotide, including by deletion of sequence fragments in the native coding sequence of cyaA.

The invention also concerns a polynucleotide encoding a variant CyaA-derived protein, wherein said first fragment is a variant with at least 95% similarity with a fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2, and/or wherein said second fragment is a variant with at least 95% similarity with a fragment beginning with a residue located from position 321 to position 387 of SEQ ID NO:2 and ending with the last residue of SEQ ID NO:2.

By "a variant with at least 95% similarity" when reference is made to a protein or a polypeptide, it is meant a protein sequence whose amino acid identity is at least 95%, at least 96%, at least 97%, at least 98% or at least 99% with the polypeptide from which it varies. The percentage of similarity is calculated, comparing the full-length sequence of both said variant and said polypeptide from which it varies, in particular over the shorter of the two sequences. Thus, a variant has 95% of similarity with a polypeptide, when 5% of its residues differ from the residues of this polypeptide, by one or more addition(s) and/or one or more deletion(s) and/or one or more substitution(s). In a particular embodiment, said variant differs from said polypeptide only by substitutions, preferably conservative substitutions and accordingly it keeps the same length as the sequence from which it varies. In another embodiment, said variant differs from said polypeptide by at least 1 single amino-acid deletion, preferably by 1, 2, 3, 4 or 5 single amino-acid deletion(s), and by substitutions, preferably conservative substitutions.

The invention also relates to polynucleotide variants having a similarity of at least 75% with the polynucleotides encoding portions (or fragments) of SEQ ID NO:1. In a particular embodiment, the polynucleotide encoding said first fragment has a similarity of 75% with a polynucleotide beginning with the first nucleotide of SEQ ID NO:1 and ends with a nucleotide located from position 549 to position 681 of SEQ ID NO:1 provided that the length of said nucleotide fragment is a multiple of 3. In another embodiment, independently or in combination with the above statement, the polynucleotide encoding said second fragment has a similarity of 75% with a polynucleotide beginning with a nucleotide located from position 961 to position 1159 of SEQ ID NO:1 and ends with the last nucleotide (i.e., nucleotide 5118) of SEQ ID NO:1, provided that the length of said nucleotide fragment is a multiple of 3. In a particular embodiment, the polynucleotides encoding said first and second fragments originate from a polynucleotide, the full-length sequence of which has at least 75% similarity with SEQ ID NO:1. An example of such variant is SEQ ID NO:69. In a particular embodiment, the polynucleotide variant results from degeneracy of the genetic code applied to the polynucleotide obtained from SEQ ID NO:1 as disclosed above or to the polynucleotide of SEQ ID NO:69. In a particular embodiment, the polynucleotide variant thus obtained has a degenerated base at the wobble position.

By "a variant with at least 75% similarly" when reference is made to a polynucleotide, it is meant a nucleotide sequence whose nucleotide identity is at least 75%, at least 79%, at least 80%, at least 85%, at least 90%, at least 95%, at least 96%, at least 97%, at least 98% or at least 99% with the polynucleotide from which it varies. The percentage of similarity is calculated, comparing the full-length sequence of both said variant and the polynucleotide from which it varies, in particular over the shorter of the two sequences. Thus, a variant has 75% of similarity with a polynucleotide, when 25% of its nucleotides differ from the nucleotides of said polynucleotide, by one or more nucleotide addition(s) and/or one or more nucleotide deletion(s) and/or one or more nucleotide substitution(s). In a particular embodiment, said variant differs only by nucleotide substitutions, and accordingly it keeps the same length as the sequence from which it varies. In a particular embodiment, said variant differs only by nucleotide silent mutations, and accordingly it keeps encoding the same protein as the one encoding by the sequence from which it varies. In a particular embodiment, said variant differs only by nucleotide substitutions, a part of them being silent mutations, such that the sequence of the protein encoded by said polynucleotide variant has at least 95% of similarity with a protein or polypeptide of the invention, or has 100% identity.

Nucleotide and protein similarity percentages as indicated herein may be calculated by well known programs based on the Needleman and Wunsch algorithm, such as MeAlign [18].

In a particular embodiment, the variant CyaA-derived protein as defined herein keeps its capacity to bind to target cells and/or to translocate its adenylate cyclase (AC) domain into the cytosol of the target cells. In a particular embodiment, target cells are CD11b-expressing cells, i.e., cells that express the CD11b/CD18 receptor on their surface (CD11b$^+$). In particular, these cells are granulocytes/neutrophils, macrophages, NK cells, subsets of T CD8$^+$, subsets of B cells, dendritic cells such as Langerhans cells, or myeloid dendritic cells.

The capacity of the variants of the invention to bind to target cells can be assayed especially according to the methods disclosed in EP03291486 or in WO02/22169 application. Furthermore, the capacity of the variant to translocate its N-terminal domain into the cytosol of target cells can be assayed by applying the method described in WO02/22169 application, or the method detailed in example A with the p105 peptide.

Variants of the full-length wild type sequence of the *Bordetella pertussis* CyaA protein are known; illustration of such variants is provided by reference to their sequence as set forth in SEQ ID NO: 4 (CyaA protein of *Bordetella hinzii*), SEQ ID NO: 6 (CyaA protein of *Bordetella parapertussis*) and SEQ ID NO: 8 (CyaA protein of *Bordetella bronchiseptica*). The nucleotide sequence, encoding SEQ ID NOs: 4, 6 and 8, is as set forth in SEQ ID NOs:3, 5 and 7 respectively or is a variant of SEQ ID NOs:3, 5 and 7 by silent mutations. Within the present invention, the CyaA-derived protein does not comprise or does not consist of SEQ ID NOs: 2, 4, 6 and 8. Moreover, a polynucleotide encoding a variant CyaA-derived protein of the invention does not comprise or does not consist of SEQ ID NOs: 3, 5 or 7.

In a particular embodiment of the invention, a polynucleotide encoding a variant CyaA-derived protein, preferably as variant of a *B. pertussis* CyaA-derived protein as defined herein, is a polynucleotide encoding a polypeptide comprising or consisting of:

(a) a fragment of the *Bordetella* CyaA protein as set forth in SEQ ID NO: 4, 6 or 8, the sequence of said fragment beginning with the first residue of SEQ ID NO:4, 6 or 8 and ending with a residue located from position 183 to position 227 of SEQ ID NO:4, 6 or 8, fused to (b) a fragment of the *Bordetella* CyaA protein as set forth respectively in SEQ ID NO: 4, 6 or 8, the sequence of said fragment beginning with a residue located from position 321 to position 387 of SEQ ID NO: 4, 6 or 8 and ending with the last residue of SEQ ID NO: 4, 6 or 8.

The definitions given above for the particular CyaA-derived protein comprising fragments of SEQ ID NO:2 apply identically to the variant CyaA-derived protein comprising fragments of SEQ ID NO:4 and 6.

Regarding the variant CyaA-derived protein comprising fragments of SEQ ID NO:8, all definitions apply identically, with the exception of the last residue of SEQ ID NO:8 is residue 1705 instead of residue 1706. Therefore, for the variant CyaA-derived protein comprising fragments of SEQ ID NO:8, all aspects referring to residue 1706 must be replaced by residue 1705. In particular, the second fragment has a size ranging from 1319 to 1385 residues, and is preferably 1319 residues or 1385 residues in length. Regarding a polynucleotide encoding variant CyaA-derived protein comprising fragments of SEQ ID NO: 8, all definitions and embodiments referring to nucleotide 5118 must be replaced by nucleotide 5115.

Particular polynucleotides encoding variant CyaA-derived proteins of the invention are selected among a polynucleotide comprising or consisting of:

1) a polynucleotide encoding the polypeptide as set forth in SEQ ID NO:13; SEQ ID NO:13 consists of a fragment consisting of residues 1 to 227 of SEQ ID NO:4 fused to a fragment consisting of residues 321 to 1706 of SEQ ID NO:4;
2) a polynucleotide encoding the polypeptide as set forth in SEQ ID NO:14; SEQ ID NO:14 consists of a fragment consisting of residues 1 to 183 of SEQ ID NO:4 fused to a fragment consisting of residues 387 to 1706 of SEQ ID NO:4;
3) a polynucleotide encoding the polypeptide as set forth in SEQ ID NO:15; SEQ ID NO:15 consists of a fragment consisting of residues 1 to 227 of SEQ ID NO:6 fused to a fragment consisting of residues 321 to 1706 of SEQ ID NO:6;
4) a polynucleotide encoding the polypeptide as set forth in SEQ ID NO:16; SEQ ID NO:16 consists of a fragment consisting of residues 1 to 183 of SEQ ID NO:6 fused to a fragment consisting of residues 387 to 1706 of SEQ ID NO:6;
5) a polynucleotide encoding the polypeptide as set forth in SEQ ID NO:17; SEQ ID NO:17 consists of a fragment consisting of residues 1 to 227 of SEQ ID NO:8 fused to a fragment consisting of residues 321 to 1705 of SEQ ID NO:8; and
6) a polynucleotide encoding the polypeptide as set forth in SEQ ID NO:18; SEQ ID NO:18 consists of a fragment consisting of residues 1 to 183 of SEQ ID NO:8 fused to a fragment consisting of residues 387 to 1705 of SEQ ID NO:8.

The polynucleotide encoding the CyaA-derived protein or the variant CyaA-derived protein of the invention may also be defined as a deleted version of the full-length *Bordetella* CyaA coding nucleotide sequence, i.e., a polynucleotide encoding a polypeptide comprising or consisting of SEQ ID NO:2, 4, 6 or 8 to the extent that it is deleted for a polynucleotide encoding a polypeptide fragment whose first amino acid residue is located from residue 184 to residue 228 of SEQ ID NO: 2, 4, 6 or 8 respectively, and whose last amino acid residue is located from residue 320 to residue 386 of SEQ ID NO: 2, 4, 6 or 8 respectively. In a particular embodiment, said polynucleotide encodes a polypeptide comprising or consisting of SEQ ID NO:2, 4, 6 or 8, which is deleted for a polynucleotide encoding a polypeptide fragment whose first amino acid residue is selected from the group consisting of residues 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227 and 228 of SEQ ID NO: 2, 4, 6 or 8 respectively, and whose last amino acid residue is selected from the group consisting of residues 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385 or 386 of SEQ ID NO: 2, 4, 6 or 8 respectively.

A method to produce a polynucleotide encoding the CyaA-derived protein in particular a variant CyaA-derived protein of the invention as described herein is also part of the invention. This method comprises the steps of (a) deleting, from a polynucleotide encoding the *Bordetella* CyaA as set forth in SEQ ID NO: 2, 4, 6 or 8, a nucleotide fragment of consecutive nucleotide residues in said sequences, the first three nucleotides of which encode an amino acid residue located from residue 184 to residue 228 of SEQ ID NO: 2, 4, 6 or 8, and the last three nucleotides of which encode an amino acid residue located from residue 320 to residue 386 of SEQ ID NO: 2, 4, 6 or 8; and (b) recovering said polynucleotide.

Alternatively, the polynucleotide encoding the CyaA-derived protein is chemically synthesized, using conventional methods, according to the sought CyaA-derived protein sequence, and optionally taking into account the degeneracy of the genetic code and/or the optimization of expression.

The invention is also directed to the CyaA derived proteins encoded by the polynucleotides of the invention, described herein. Particular CyaA derived proteins consist of a sequence as set forth in SEQ ID NO: 10, 12, 13, 14, 15, 16, 17, 18, 19 and 20.

Within the frame of the invention, a polynucleotide encoding a CyaA-derived protein, including a variant CyaA-derived protein is used to produce a chimeric polynucleotide of the invention encoding a chimeric protein comprising or consisting of said CyaA-derived protein or variant CyaA-derived protein, and a heterologous polypeptide, wherein the polynucleotide encoding said heterologous polypeptide substitutes the deleted nucleotide fragment of CyaA.

Accordingly the invention relates to a chimeric polynucleotide, i.e., a polynucleotide encoding a chimeric protein as defined herein, wherein each and every embodiments disclosed herein in relation to the polynucleotide encoding the CyaA derived protein applies.

Thus, the invention also relates to a method to produce a polynucleotide encoding a chimeric protein, comprising:

(a) deleting, from a polynucleotide encoding the *Bordetella* CyaA as set forth in SEQ ID NO: 2, 4, 6 or 8 or encoding a variant with at least 95% similarity with SEQ ID NO: 2, a nucleotide fragment, the first three nucleotides of which encode an amino acid residue located from residue 184 to residue 228 of SEQ ID NO: 2, 4, 6 or 8, whose the last 3 nucleotides of which encode an amino acid residue located from residue 320 to residue 386 of SEQ ID NO: 2, 4, 6 or 8;

(b) inserting, in the polynucleotide obtained in (a) and at the site of the deleted nucleotide fragment, a polynucleotide encoding a heterologous polypeptide; wherein steps (a) and (b) may be carried out in any order or simultaneously; and (c) recovering said polynucleotide encoding a chimeric protein.

The invention also relates to a method to produce a chimeric protein, comprising:

(a) deleting, from a polynucleotide encoding the *Bordetella* CyaA as set forth in SEQ ID NO: 2, 4, 6 or 8 or encoding a variant with at least 95% similarity with SEQ ID NO: 2, a nucleotide fragment, the first three nucleotides of which encode an amino acid residue located from residue 184 to residue 228 of SEQ ID NO: 2, 4, 6 or 8, whose the last 3 nucleotides of which encode an amino acid residue located to from residue 320 to residue 386 of SEQ ID NO: 2, 4, 6 or 8;

(b) inserting, in the polynucleotide obtained in (a) and at the site of the deleted nucleotide fragment, a polynucleotide encoding a heterologous polypeptide; wherein steps (a) and (b) may be carried out in any order or simultaneously;

(c) expressing, in a cell, the polynucleotide obtained in (b); and (d) recovering said expressed chimeric protein.

The method to produce the chimeric protein of the invention may further comprise the step of combining in a chimeric polynucleotide construct the polynucleotide obtained in step (b) and a polynucleotide encoding the CyaC protein. In a preferred embodiment the polynucleotide obtained in step (b) and a polynucleotide encoding the CyaC protein are combined in a construct in such a way that following said combination, the obtained chimeric polynucleotide comprises or contains, from 5' end to 3' end, the polynucleotide construct of step (b) followed by a polynucleotide construct encoding a CyaC protein of a *Bordetella* strain, in particular of a *Bordetella pertussis* strain.

Within the present invention, when reference is made to the "first three nucleotides" or the "last three nucleotides", it is understood that these three nucleotides refer to a codon which corresponds, according to the genetic code, to a amino acid residue identified by its position in SEQ ID NO: 2, 4, 6 or 8. Thus, the size of the polynucleotide nucleotide deletion is a multiple of 3. Moreover, in addition to be a multiple of 3 in size, the polynucleotide nucleotide deletion is in frame, i.e., the deletion removes the sought amino acid residues, without modifying the reading frame, nor modifying the residues surrounding (upstream and downstream) the deletion.

The order of the steps of deletion and of the step of insertion is indifferent and both steps can be carried out simultaneously.

In a first embodiment of the method, the step of deletion is implemented before the step of insertion. Thus, once the deletion of the fragment has been carried out, the polynucleotide encoding the heterologous polypeptide is inserted at the site of the deleted nucleotide fragment. By "at the site of the deleted nucleotide fragment", it is meant that the polynucleotide encoding the heterologous polypeptide is inserted between the N-terminal side of CyaA (corresponding to the first CyaA fragment) and the C-terminal side of CyaA (corresponding to the second CyaA fragment). The site of insertion can be easily identified, since the sequence of both the N-terminal side and the C-terminal side of CyaA are identical to the sequence of the N-terminal part and C-terminal part of SEQ ID NO:2, 4, 6 or 8 or variants according to the invention.

In a second embodiment, the step of insertion is implemented before the step of deletion. Once the fragment to be deleted has been identified, the polynucleotide encoding the heterologous polypeptide is inserted either upstream (in 5') of the three nucleotides (codon) encoding the first residue of the fragment to be deleted, or downstream (in 3') of the last three nucleotides (codon) encoding the last residue of the fragment to be deleted. Once the insertion of the polynucleotide encoding the heterologous polypeptide has been made, the fragment to be deleted is excised from the polynucleotide encoding the CyaA/heterologous polypeptide molecule.

In a third embodiment, both steps of deletion and of insertion are carried out simultaneously, i.e., in a single reaction step, using appropriate restriction enzymes. In a particular embodiment of the method, the step of deletion comprises removing, from a polynucleotide encoding a *Bordetella* CyaA as set forth in SEQ ID NO: 2, 4, 6 or 8, a nucleotide fragment encoding the residues 228 to 320 of SEQ ID NO: 2, 4, 6 or 8, or a nucleotide fragment encoding the residues 184 to 386 of SEQ ID NO: 2, 4, 6 or 8, or a nucleotide fragment encoding the residues 228 to 386 of SEQ ID NO: 2, 4, 6 or 8, or a nucleotide fragment encoding the residues 184 to 320 of SEQ ID NO: 2, 4, 6 or 8 or variants according to the invention.

In another embodiment, the step of deletion comprises removing, from a polynucleotide as set forth in SEQ ID NO: 1, 3, 5 or 7 or SEQ ID NO:69, a nucleotide fragment consisting of nucleotides 682 to 960 of SEQ ID NO: 1, 3, 5 or 7 or SEQ ID NO:69, or a nucleotide fragment consisting of nucleotides 550 to 1158 of SEQ ID NO: 1, 3, 5 or 7 or SEQ ID NO:69, or a polynucleotide as set forth in SEQ ID NO: 1, 3, 5 or 7 or SEQ ID NO:69, or a nucleotide fragment consisting of nucleotides 682 to 1158 of SEQ ID NO: 1, 3, 5 or 7 or SEQ ID NO:69, or a nucleotide fragment consisting of nucleotides 550 to 960 of SEQ ID NO: 1, 3, 5 or 7 or SEQ ID NO:69.

To carry out the fragment deletion, the skilled person will possibly need to perform a larger deletion in the CyaA encoding polynucleotide and will then compensate when cloning the polynucleotide encoding the heterologous polypeptide to achieve the above disclosed deletion as a final result.

Alternatively, the chimeric polynucleotide encoding the chimeric protein of the invention is chemically synthesized, using conventional methods, according to the sought chimeric protein sequence, and optionally taking into account the degeneracy of the genetic code and/or the optimization of expression. Thus, said chemically synthesized polynucleotide is expressed in a cell and the expressed chimeric protein is thus recovered.

The invention also relates to a polynucleotide encoding a chimeric protein, said polynucleotide comprising or consisting, from 5' to 3', (a) a polynucleotide encoding a fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2, or a variant with at least 95% similarity with said fragment, (b) a polynucleotide encoding a heterologous polypeptide and (c) a polynucleotide encoding a fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2 or a variant with at least 95% similarity with said fragment. The definitions described above for the CyaA-derived protein, regarding the fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2, and regarding the fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2, apply identically to these fragments in the context of the polynucleotide encoding a chimeric protein.

The definitions described above regarding variants with at least 95% apply identically to the variants of the fragments described in the context of the polynucleotide encoding a chimeric protein.

In a particular embodiment, said polynucleotide encoding a chimeric protein is selected from the group consisting of:

1) a polynucleotide comprising or consisting of, from 5' to 3', (a) a polynucleotide encoding a polypeptide fragment consisting of residues 1 to 227 of SEQ ID NO:2, 4 or 6, (b) a polynucleotide encoding a heterologous polypeptide, and (c) a polynucleotide encoding a polypeptide fragment consisting of residues 321 to 1706 of SEQ ID NO:2, 4 or 6;

2) a polynucleotide comprising or consisting of, from 5' to 3', (a) a polynucleotide encoding a polypeptide fragment consisting of residues 1 to 227 of SEQ ID NO:8, (b) a polynucleotide encoding a heterologous polypeptide, and (c) a polynucleotide encoding a polypeptide fragment consisting of residues 321 to 1705 of SEQ ID NO:8;

3) a polynucleotide comprising or consisting of, from 5' to 3', (a) a polynucleotide encoding a polypeptide fragment consisting of residues 1 to 183 of SEQ ID NO:2, 4 or 6, (b) a polynucleotide encoding a heterologous polypeptide, and (c) a polynucleotide encoding a polypeptide fragment consisting of residues 387 to 1706 of SEQ ID NO:2, 4 or 6;

4) a polynucleotide comprising or consisting of, from 5' to 3', (a) a polynucleotide encoding a polypeptide fragment consisting of residues 1 to 183 of SEQ ID NO:8, (b) a polynucleotide encoding a heterologous polypeptide, and (c) a polynucleotide encoding a polypeptide fragment consisting of residues 387 to 1705 of SEQ ID NO:8;

5) a polynucleotide comprising or consisting of, from 5' to 3', (a) a polynucleotide encoding a polypeptide fragment consisting of residues 1 to 227 of SEQ ID NO:2, 4 or 6, (b) a polynucleotide encoding a heterologous polypeptide, and (c) a polynucleotide encoding a polypeptide fragment consisting of residues 387 to 1706 of SEQ ID NO:2, 4 or 6;

6) a polynucleotide comprising or consisting of, from 5' to 3', (a) a polynucleotide encoding a polypeptide fragment consisting of residues 1 to 227 of SEQ ID NO:8, (b) a polynucleotide encoding a heterologous polypeptide, and (c) a polynucleotide encoding a polypeptide fragment consisting of residues 387 to 1705 of SEQ ID NO:8;

7) a polynucleotide comprising or consisting of, from 5' to 3', (a) a polynucleotide encoding a polypeptide fragment consisting of residues 1 to 183 of SEQ ID NO:2, 4 or 6, (b) a polynucleotide encoding a heterologous polypeptide, and (c) a polynucleotide encoding a polypeptide fragment consisting of residues 321 to 1706 of SEQ ID NO:2, 4 or 6; and 8) a polynucleotide comprising or consisting of, from 5' to 3', (a) a polynucleotide encoding a polypeptide fragment consisting of residues 1 to 183 of SEQ ID NO:8, (b) a polynucleotide encoding a heterologous polypeptide and (c) a polynucleotide encoding a polypeptide fragment consisting of residues 321 to 1705 of SEQ ID NO:8;

In a particular embodiment of any polynucleotide encoding a chimeric protein as defined herein, the polynucleotide of (a) is fused to the polynucleotide of (b) which is itself fused to the polynucleotide of (c).

Within the present invention, the polynucleotide encoding the heterologous polypeptide has a size which is a multiple of 3, in order to keep the reading frame of the polynucleotide of (c) (e.g., the reading frame of the fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2, or variant thereof).

In a particular embodiment of the invention, the chimeric polynucleotide further comprises, at its 3' end a polynucleotide encoding the CyaC protein of a *Bordetella* strain, in particular of a *Bordetella pertussis* strain.

A polynucleotide encoding a chimeric protein can be obtained or obtainable by the method described herein.

The invention is also directed to a nucleic acid vector, such as a plasmid, comprising a polynucleotide as defined herein, i.e., either a polynucleotide encoding a CyaA derived protein including a variant CyaA derived protein, or a polynucleotide encoding a chimeric protein. In a particular embodiment, the vector is an expression vector, i.e., a vector which comprises, besides the elements explicitly mentioned, all the elements necessary to drive the expression of the polynucleotide of the invention (expression control sequence), and particularly transcription regulatory elements. "Transcription regulatory element" defines any DNA regions involved in the regulation of transcription of the polynucleotide and encompasses a promoter, such as a promoter inducible by IPTG, for example lac, tac or T7 promoter, or a promoter inducible by temperature shift, for example phage lambda pR or pL promoter, enhancer or cis-acting regulatory elements. These elements, and particularly the promoter, are chosen depending upon the nature of the cells to be transfected with the nucleic acid vector. The determination of the suitable promoter, according to the expression level sought or to the transfected cell, makes part of the knowledge of the person skilled in the art. In a particular embodiment, said vector is a plasmid. Examples of conventional plasmids suitable for the preparation of the vector of the invention are pUC or pBR322.

In a particular embodiment, said nucleic acid vector also comprises the CyaC coding sequence of a *Bordetella* strain, such as the cyaC gene of *B. pertussis* as set forth in SEQ ID NO:21. In another embodiment, said nucleic acid vector also comprises a version of the CyaC coding sequence of a *Bordetella* strain which is optimized for a better expression in a particular cell type, in particular optimized for a better expression in *E. coli*. An optimized version of the CyaC sequence for *E. coli* is as set forth in SEQ ID NO:22.

Particular plasmids which can be used to produce a chimeric protein as defined in the invention are the ones described in the material and methods, and whose sequences are as set forth in SEQ ID NOs: 59, 62, 65 and 68. The polynucleotide encoding the heterologous polypeptide contained in these four plasmids can be removed and replaced by a polynucleotide encoding a heterologous polypeptide as described herein. Thus, starting from the plasmid of SEQ ID NO:59, the sequence contained between nucleotides 904 and 1731 is removed and replaced by a polynucleotide encoding a heterologous polypeptide as described herein. Alternatively, starting from the plasmid of SEQ ID NO:62, the sequence contained between nucleotides 772 and 1599 is removed and replaced by a polynucleotide encoding a heterologous polypeptide as described herein. Alternatively, starting from the plasmid of SEQ ID NO:65, the sequence contained between nucleotides 904 and 1836 is removed and replaced by a polynucleotide encoding a heterologous polypeptide as described herein. Alternatively, starting from the plasmid of SEQ ID NO:68, the sequence contained between nucleotides 772 and 1704 is removed and replaced by a polynucleotide encoding a heterologous polypeptide as described herein.

It is noteworthy that, when the nucleic vector contains several polynucleotides, the transcription regulatory element(s) may be unique for all the polynucleotides or shared by some of them or in contrast each polynucleotide may be associated with one or more particular transcription regulatory element(s). In the latter case, the several transcription regulatory elements may be similar or different.

The invention is also directed to a cell (preferably isolated) or a cell culture comprising a polynucleotide as defined herein, i.e., either a polynucleotide encoding a CyaA derived protein including a variant CyaA derived protein, or a polynucleotide encoding a chimeric protein, or comprising a vector as defined herein. In a particular embodiment, said cell or cell culture is transfected with a vector of the invention.

Said cell can be a prokaryotic or a cell culture made of prokaryotic cells. In a particular embodiment, said cell is suitable to express and/or to produce recombinant protein(s). In a particular embodiment, said cell or cell culture is a bacterium or a bacteria culture. In a preferred embodiment, said cell or cell culture is an *E. coli* strain culture, such as the BL21, BLR, TG1 or HMS174 strain.

Thus, the cell or cell culture of the invention expresses the polynucleotide of the invention, i.e., either a polynucleotide encoding a CyaA derived protein including variant CyaA derived protein, or a polynucleotide encoding a chimeric protein, and when appropriate, simultaneously the cyaC gene or an optimized version of the cyaC gene.

The term "CyaA" or "CyaA-derived protein" or "chimeric protein" encompasses, and preferably is, a post-translational modified version of the *Bordetella* CyaA protein. Thus, in a particular embodiment, said "CyaA-derived protein" or "chimeric protein" of the invention is modified by post-translational acylation of at least one of its residues, in particular at least one of the two, preferably the two, lysine residues corresponding to the residues located in positions 860 and 983 of the full length sequence of *B. pertussis, B. hinzii* or *B parapertussis* CyaA or corresponding to the residues located in positions 859 and 982 of the full length sequence of *B. bronchiseptica* CyaA. By "acylation", it is meant herein palmitoylation, i.e., addition of palmitate and/or palmitoleate group(s) on residue(s) of CyaA, of the CyaA-derived protein or of the chimeric protein of the invention. Thus, said "CyaA-derived protein" or "chimeric protein" bears a palmitoyl group on some of these residues, preferably on one of the two, or the two, lysine residues corresponding to the residues 860 and 983 of the full length sequence of *B. pertussis, B. hinzii* or *B parapertussis* CyaA or corresponding to the residues located in positions 859 and 982 of the full length sequence of *B. bronchiseptica* CyaA. By "corresponding to", it is meant that the residue(s) which is (are) post-translationally modified in the CyaA-derived protein or chimeric protein of the invention is (are) the one(s) the position of which matches the lysines 860 and 983 in the sequence of CyaA of *B. pertussis, B. hinzii* or *B parapertussis* CyaA (SEQ ID NO:2, 4 and 6 respectively) or the lysines 859 and 982 in the sequence of *B. bronchiseptica* CyaA (SEQ ID NO:8). The identification of these lysine residues in the proteins of the invention can be carried out by the person skilled in the art, by aligning and comparing the sequence of the proteins of the invention with the sequence as defined in SEQ ID NO:2, 4, 6 or 8.

The process of palmitoylation is mediated by the cyaC gene of a *Bordetella* species, preferably of the *Bordetella pertussis* CyaC coding sequence, the natural sequence of which is set forth in SEQ ID NO:21. A version of the CyaC coding sequence, optimized for production in *E. coli*, is set forth in SEQ ID NO:22. This (these) post translational modification(s) may be obtained by co-expression of the polynucleotide encoding CyaA protein, the polynucleotide encoding the CyaA-derived protein of the invention or the polynucleotide encoding the chimeric protein of the invention, and of the cyaC gene.

In a particular embodiment, the polynucleotide construct of the invention expressing the CyaA and CyaC proteins comprises from 5' end to 3' end, the cyaA polynucleotide or gene, advantageously consisting of an optimized sequence for expression in a determined host cell, e.g. *E. Coli* and the cyaC polynucleotide or gene, advantageously consisting of an optimized sequence for expression in a determined host cell, e.g. *E. Coli*. This order of the insertion of the polynucleotides in the construct favours the expression of the CyaA and CyaC proteins in respective quantities and conformation suitable for increasing efficiency of expression of post translational modified version of CyaA.

In a particular embodiment of the invention, except for the deletion of the fragment [whose first amino acid residue is located from residue 184 to residue 228 of SEQ ID NO: 2, 4, 6 or 8 respectively, and whose last amino acid residue is located from residue 320 to residue 386 of SEQ ID NO: 2, 4, 6 or 8 respectively] carried out in the wild type *Bordetella* CyaA protein disclosed herein, the CyaA-derived protein of the invention or the CyaA part of the chimeric protein does not undergo any other variation (addition, deletion and/or substitution) as compared to SEQ ID NO:2, 4, 6 or 8.

Interestingly, the CyaA derived protein as well as the chimeric protein of the invention are non cytotoxic, i.e., their enzymatic activity has been inactivated following the deletion of the fragment whose first amino acid residue is located from residue 184 to residue 228 of SEQ ID NO: 2, 4, 6 or 8 respectively, and whose last amino acid residue is located from residue 320 to residue 386 of SEQ ID NO: 2, 4, 6 or 8 respectively. Therefore, in a particular embodiment, no insertion, deletion or substitution has been carried out. In particular, when the residues 188 and 189 of CyaA are still present in the proteins of the invention, no dipeptide (such as the dipeptide LQ or GS) is inserted between the residues 188 and 189.

The invention also concerns a chimeric protein which is encoded by a polynucleotide of the invention, expressed from a vector of the invention or produced by a cell culture of the invention.

A chimeric protein of the invention comprises or consists of, from N-terminal to C-terminal, (a) a fragment of the *Bordetella pertussis* CyaA protein as set forth in SEQ ID NO: 2, the sequence of said fragment beginning at the first residue of SEQ ID NO:2 and ending at a residue located from position 183 to position 227 of SEQ ID NO:2 or a variant with at least 95% similarity with this fragment, (b) a heterologous polypeptide, and (c) a fragment of the *Bordetella pertussis* CyaA protein as set forth in SEQ ID NO: 2, the sequence of said fragment beginning at a residue located from position 321 to position 387 of SEQ ID NO:2 and ending at the last residue of SEQ ID NO:2 or a variant with at least 95% similarity with this fragment.

The definitions described above for the CyaA-derived protein, regarding the fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2, and regarding the fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2, apply identically to these fragments in the context of the polynucleotide encoding a chimeric protein.

The definitions described above regarding variants with at least 95% apply identically to the fragments described in the context of a chimeric protein.

Thus, the invention is also directed to a chimeric protein comprising or consisting of:
1) from N-terminal to C-terminal, (a) a fragment consisting of residues 1 to 227 of SEQ ID NO:2, 4 or 6, (b) a heterologous polypeptide and (c) a fragment consisting of residues 321 to 1706 of SEQ ID NO:2, 4 or 6;

2) from N-terminal to C-terminal, (a) a fragment consisting of residues 1 to 227 of SEQ ID NO:8, (b) a heterologous polypeptide and (c) a fragment consisting of residues 321 to 1705 of SEQ ID NO:8;

3) from N-terminal to C-terminal, (a) a fragment consisting of residues 1 to 183 of SEQ ID NO:2, 4 or 6, (b) a heterologous polypeptide and (c) a fragment consisting of residues 387 to 1706 of SEQ ID NO:2, 4 or 6; and 4) from N-terminal to C-terminal, (a) a fragment consisting of residues 1 to 183 of SEQ ID NO:8, (b) a heterologous polypeptide and (c) a fragment consisting of residues 387 to 1705 of SEQ ID NO:8.

In a particular embodiment of chimeric proteins as defined herein, the fragment of (a) is fused to the heterologous polypeptide of (b) which is itself fused to the fragment of (c).

By "chimeric", it is meant that the protein comprises or consists of, as defined herein, of fragments originating from a *Bordetella* CyaA, and one polypeptide which does not originate from a *Bordetella* CyaA. Therefore, said polypeptide is said heterologous, i.e., its overall sequence is not identical to a part of a *Bordetella* CyaA, in particular, to a part of a CyaA as set forth in SEQ ID NO:2, 4, 6 or 8; in a particular embodiment, the overall sequence of this heterologous polypeptide is not similar to a part of a *Bordetella* CyaA, in particular to a part of a CyaA as set forth in SEQ ID NO:2, 4, 6 or 8, i.e., its sequence has a similarity which is less than 80%, less than 70%, less than 60%, less than 50%, less than 40%, less than 30% or less than 20% with a part of a *Bordetella* CyaA, in particular with a part of a CyaA protein as set forth in SEQ ID NO:2, 4, 6 or 8, said similarity being calculated for this definition by comparing the sequence of the heterologous polypeptide and the one of the part of a *Bordetella* CyaA at equivalent size (the heterologous polypeptide and the part of a *Bordetella* CyaA having the same size). In a particular embodiment, the sequence of the heterologous peptide and the sequence of the portions (or fragment) originating from *Bordetella* CyaA as defined herein, do not share identity (100% similarity) over more than 7 consecutive amino acid residues.

In a particular embodiment, the heterologous polypeptide has a size ranging from 9 to 500 amino acid residues, in particular 9 to 400 residues, 9 to 300 residues, 9 to 200 residues, 9 to 100 residues, 20 to 500 residues, 20 to 400 residues, 20 to 300 residues, 20 to 200 residues, 20 to 100 residues, 50 to 500 residues 50 to 400 residues, 50 to 300 residues, 50 to 200 residues, 50 to 100 residues, 100 to 500 residues, 100 to 400 residues, 100 to 300 residues or 100 to 200. The size of the polynucleotide encoding the heterologous polypeptide ranges from 27 to 1500 nucleotides, in particular 27 to 1200 nucleotides, 27 to 900 nucleotides, 27 to 600 nucleotides, 27 to 300 nucleotides, 60 to 1500 nucleotides, 60 to 1200 nucleotides, 60 to 900 nucleotides, 60 to 600 nucleotides, 60 to 300 nucleotides, 150 to 1500 nucleotides 150 to 1200 nucleotides, 150 to 900 nucleotides, 150 to 600 nucleotides, 150 to 300 nucleotides, 300 to 1500 nucleotides, 300 to 1200 nucleotides, 300 to 900 nucleotides or 300 to 600, provided that the size (number of nucleotides) of the polynucleotide is a multiple of 3.

In a particular embodiment, the heterologous polypeptide, preferably in combination with the size ranges defined above, has an electrostatic charge that is negative, i.e., the heterologous polypeptide is acidic. In another embodiment, a fragment of the heterologous polypeptide has an electrostatic charge that is negative, i.e., this fragment of said heterologous polypeptide is acidic. A fragment of heterologous polypeptide is defined has a concatenation of consecutive amino acid residues, the size of which is from 10% to 40%, preferably 15% to 30%, of the size of the entire heterologous polypeptide.

In particular, the electrostatic charge is defined as the number of lysine and arginine residues minus the number of aspartic acid and glutamic acid residues contained in the heterologous polypeptide. In an embodiment, the electrostatic charge of the heterologous polypeptide is equal to −1 or is less than −1, and in particular is equal to or is less than −2, −3, −4, −5, −10, −15, −20, −30, −40, −45 or −50. In a particular embodiment, preferably in combination with one of the values of the previous sentence, the electrostatic charge of the heterologous polypeptide is not less than −55, −60, −70 or −80. In other words, the electrostatic charge of the heterologous polypeptide is in the range from −55 to −1, −50 to −2 or −40 to −3. As a comparison, the classical OVA epitope (SIINFEKL) has an electrostatic charge of 0.

Examples of several heterologous polypeptides, tested within chimeric proteins of the invention, are reported herein:

- peptide 216 (SEQ ID NO:34), tested in chimeric proteins Btpr_114 and Btpr_116, has an electrostatic charge of −16;
- peptide 217 (SEQ ID NO:36), tested in chimeric protein Btpr_115 and Btpr_117, has an electrostatic charge of −37;
- peptide 233 (SEQ ID NO:38), tested in chimeric protein Btpr_143 and Btpr_144, has an electrostatic charge of −13;
- peptide 234 (SEQ ID NO:40), tested in chimeric protein Btpr_145 and Btpr-146, has an electrostatic charge of −38;
- peptide 326 (SEQ ID NO:42), tested in chimeric protein Btpr_161 and Btpr_169, has an electrostatic charge of −11;
- peptide 327 (SEQ ID NO:46), tested in chimeric protein Btpr_162 and Btpr_170, has an electrostatic charge of −10;
- peptide 328 (SEQ ID NO:50), tested in chimeric protein Btpr_163 and Btpr_171, has an electrostatic charge of −18;
- peptide 329 (SEQ ID NO:54), tested in chimeric protein Btpr_164 and Btpr-172, has an electrostatic charge of −19;
- peptide 330 (SEQ ID NO:44), tested in chimeric protein Btpr_165 and Btpr_173, has an electrostatic charge of −30;
- peptide 331 (SEQ ID NO:48), tested in chimeric protein Btpr_166 and Btpr_174, has an electrostatic charge of −30;
- peptide 332 (SEQ ID NO:52), tested in chimeric protein Btpr_167 and Btpr_175, has an electrostatic charge of −45; and
- peptide 333 (SEQ ID NO:56), tested in chimeric protein Btpr_168 and Btpr_176, has an electrostatic charge of −46.

In a particular embodiment, said heterologous polypeptide comprises or consists of one or several antigen(s), each antigen comprising one or several epitope(s) as defined herein. Within the present invention, an antigen is defined as a polypeptide which is able to elicit an immune response, in particular a T cell immune response, against one or several epitopes contained in this polypeptide (immunogenic polypeptide). An antigen is either a full-length antigenic polypeptide of cellular or viral origin, a fragment of this full-length antigenic polypeptide able to elicit an immune response, in particular a T cell immune response, against an antigenic determinant contained in this fragment, or a synthetic, non-natural polypeptide which carries epitope(s) consisting of several parts of the antigenic polypeptide fused together or a synthetic, non-natural polypeptide consisting of one or several part(s) of several antigenic polypeptides fused together, provided that the synthetic polypeptide is able to elicit a T cell immune response, against an antigenic determinant contained in this synthetic polypeptide.

Thus, said heterologous polypeptide bears, comprises or consists of at least one epitope(s), preferably at least one $CD8^+$ epitope(s) and/or at least one $CD4^+$ epitope(s). By "at least", it is meant one or a plurality of epitopes. An epitope is defined herein as any amino acid sequence involved in the elicitation or induction of a cell-mediated immune response, especially a T cell immune response, and is either linear or conformational. Accordingly, epitopes described herein include those which are processed by APC (Antigen Presenting Cells) in a host, especially T epitopes recognized in association with class I MHC (Major Histocompatibility Complex) molecules, such as epitopes which target cells are $CD8^+$ T lymphocytes, or T epitopes recognized in association with class II MHC molecules, such as those which target cells are $CD4^+$ T lymphocytes. Epitopes within the present invention have preferably a size ranging from 9 to 17, preferably 9 to 12, residues. Epitopes described herein include also B epitope(s) involved in humoral response.

A particular heterologous polypeptide comprising several antigens with various origins has been designed by the inventors. This heterologous polypeptide bears antigens which include murine and human MHC class I (CD8 response) and MHC class II (CD4 response) restricted T-cell epitopes: GFP11, $MOG_{35-55}$, $OVA_{257-264}$, $IE_{191-110}$, CLA4, $HA_{512-520}$, $OVA_{323-339}$, $MELAN-A_{26-35}$, $HA_{307-319}$, $LCMV\ GP_{33-41}$, $MAGEA3_{111-180}$, $MAGEA3_{244-285}$, fragment of HPV16E7 and fragment of HPV18E7. The amino acid sequence of this antigen is as set forth in SEQ ID NO:24, and is part of the present invention.

In a particular embodiment, said heterologous polypeptide comprises or consists of at least one antigen(s) or at least one epitope(s), said at least one antigen(s) or at least one epitope(s) being of viral origin. Thus, said at least one antigen(s) or at least one epitope(s) originates from HIV, HBV, HCV, adenoviruses, EBV, herpes virus, HTLV.1 virus and CMV. In particular embodiment, said at least one antigen(s) or at least one epitope(s) originates from HPV. In a particular embodiment, said heterologous polypeptide, at least one antigen(s) or at least one epitope(s) does not originate from HPV. In a particular embodiment, when the polypeptide comprises or consists of more than one epitope or more than one antigen, these epitopes or antigens originate from the same Order, the same Group, the same Family, the same Subfamily, the same Genus or the same species and/or originates from different Orders, different Groups, different Families, different Subfamilies, different Genus or different species.

In a particular embodiment, said heterologous polypeptide comprises or consists of at least one antigen(s) or at least one epitope(s), said at least one antigen(s) or at least one epitope(s) being of cellular origin. Thus, said at least one antigen(s) or at least one epitope(s) originates from a prokaryote or eukaryote cell.

In an embodiment, said at least one antigen(s) or at least one epitope(s) originates from bacteria, fungus or a parasite, such as, but not limited to, *Chlamydia, Plasmodium, Candida, Leishmania* or *Mycobacterium tuberculosis*. In a particular embodiment, said at least one antigen(s) or at least one epitope(s) does not originate from *Bordetella* strain. In another particular embodiment, said at least one antigen(s) or at least one epitope(s) originates from an antigen of *Bordetella* strain which is not CyaA. In a particular embodiment, when the polypeptide comprises or consists of more than one epitope or more than one antigen, these epitopes or antigens originate from the same bacteria, the same fungus or the same parasite. In another embodiment, when the polypeptide comprises or consists of more than one epitope or more than one antigen, these epitopes or antigens originate from different bacteria, different fungus or different parasite.

In another embodiment, said at least one antigen(s) or at least one epitope(s) originates from mammalian cell. In a particular embodiment, said at least one antigen(s) or at least one epitope(s) is from a tumour antigen, i.e., a peptide expressed by tumour or by cancerous cells, the tumour being self or induced by a pathogen; in a particular embodiment, the tumour antigen is self, in particular of human origin. The term "tumour antigen" encompasses the following groups of tumour antigens, and the heterologous polypeptide contained in the chimeric protein of the invention may be chosen in at least one of the following groups: (a) oncofetal tumour antigens, (b) oncoviral tumour antigens, (c) overexpressed/accumulated tumour antigens, expressed in a wide variety of normal tissues and overexpressed in tumours, (d) shared tumour-specific antigens or cancer-Testis antigens, expressed in many tumours but not in normal tissues (including BAGE family, GAGE family, MAGE family, SAGE family and XAGE family), (e) lineage-restricted tumour antigens, (f) mutated tumour antigens, resulting from point mutations in genes that are ubiquitously expressed; and (g) differentiation tumour antigens, expressed in the normal tissue of origin of the tumours but which are not tumour-specific.

When a heterologous polypeptide of the invention comprises several antigens, these antigens are either fused, are separated by peptide linkers or at least two of said antigens are fused whereas at least two of said antigens are separated by a linker. In a particular embodiment, said peptide linker has a size ranging from 2 to 10 residues. The linkers may be added to separate antigens and/or to improve immune response.

In a particular embodiment, said heterologous polypeptide comprises or consists of at least one antigen(s) or at least one epitope(s), said at least one antigen(s) or at least one epitope(s) originates from HPV. In a particular embodiment, said heterologous polypeptide comprises or consists of 2, 3, 4, 5, 6, 7, 8, 9 or 10 antigens originating from HPV. In a preferred embodiment, said heterologous polypeptide comprises at least 3 HPV antigens, each HPV antigen originating from a different HPV type. In a particular embodiment, said HPV antigen(s) comprises or consists of at least one epitope (s), preferably at least one $CD8^+$ epitope(s) and/or at least one $CD4^+$ epitope(s).

Thus, the invention is directed to a chimeric protein comprising or consisting of, from N-terminal to C-terminal:

(a) a fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2 or a variant with at least 95% similarity with this fragment;

(b) a heterologous polypeptide comprising at least 3 HPV antigens, each HPV antigen originating from a different HPV type; and (c) a fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2 or a variant with at least 95% similarity with this fragment.

The definitions described above for the CyaA-derived protein, regarding the fragment of the *Bordetella pertussis* CyaA protein as set forth in SEQ ID NO: 2, the sequence of said fragment beginning with the first residue of SEQ ID NO:2 and ending with a residue located from position 183 to position 227 of SEQ ID NO:2, and regarding the fragment of the *Bordetella pertussis* CyaA protein as set forth in SEQ ID NO: 2, the sequence of said fragment beginning with a residue located from position 321 to position 387 of SEQ ID NO:2 and ending with the last residue of SEQ ID NO:2, apply identically to these fragments in the context of the polynucleotide encoding a chimeric protein.

The definitions described above regarding variants with at least 95% apply identically to the fragments described in the context of a chimeric protein. Similarly the definitions relating to the heterologous polypeptide apply to define the polynucleotide encoding said heterologous polypeptide.

In a particular embodiment, the chimeric protein of the invention comprises or consists of, 1) from N-terminal to C-terminal, (a) a fragment consisting of residues 1 to 227 of SEQ ID NO:2, 4 or 6, (b) a heterologous polypeptide comprising at least 3 HPV antigens, each HPV antigen originating from a different HPV type; and (c) a fragment consisting of residues 321 to 1706 of SEQ ID NO:2, 4 or 6;

2) from N-terminal to C-terminal, (a) a fragment consisting of residues 1 to 227 of SEQ ID NO:8, (b) a heterologous polypeptide comprising at least 3 HPV antigens, each HPV antigen originating from a different HPV type; and (c) a fragment consisting of residues 321 to 1705 of SEQ ID NO:8;

3) from N-terminal to C-terminal, (a) a fragment consisting of residues 1 to 183 of SEQ ID NO:2, 4 or 6, (b) a heterologous polypeptide comprising at least 3 HPV antigens, each HPV antigen originating from a different HPV type; and (c) a fragment consisting of residues 387 to 1706 of SEQ ID NO:2, 4 or 6;

4) from N-terminal to C-terminal, (a) a fragment consisting of residues 1 to 183 of SEQ ID NO:8, (b) a heterologous polypeptide comprising at least 3 HPV antigens, each HPV antigen originating from a different HPV type; and (c) a fragment consisting of residues 387 to 1705 of SEQ ID NO:8;

5) from N-terminal to C-terminal, (a) a fragment consisting of residues 1 to 227 of SEQ ID NO:2, 4 or 6, (b) a heterologous polypeptide comprising at least 3 HPV antigens, each HPV antigen originating from a different HPV type; and (c) a fragment consisting of residues 387 to 1706 of SEQ ID NO:2, 4 or 6;

6) from N-terminal to C-terminal, (a) a fragment consisting of residues 1 to 227 of SEQ ID NO:8, (b) a heterologous polypeptide comprising at least 3 HPV antigens, each HPV antigen originating from a different HPV type; and (c) a fragment consisting of residues 387 to 1705 of SEQ ID NO:8;

7) from N-terminal to C-terminal, (a) a fragment consisting of residues 1 to 183 of SEQ ID NO:2, 4 or 6, (b) a heterologous polypeptide comprising at least 3 HPV antigens, each HPV antigen originating from a different HPV type; and (c) a fragment consisting of residues 321 to 1706 of SEQ ID NO:2, 4 or 6; and 8) from N-terminal to C-terminal, (a) a fragment consisting of residues 1 to 183 of SEQ ID NO:8, (b) a heterologous polypeptide comprising at least 3 HPV antigens, each HPV antigen originating from a different HPV type; and (c) a fragment consisting of residues 321 to 1705 of SEQ ID NO:8.

The expression "HPV type" encompasses any HPV type, especially HPV types selected among the genus Alpha-papillomavirus, Beta-papillomavirus, Gamma-papillomavirus, Delta-papillomavirus, Epsilon-papillomavirus, Zeta-papillomavirus, Eta-papillomavirus, Theta-papillomavirus, Iota-papillomavirus, Kappa-papillomavirus, Lambda-papillomavirus, Mu-papillomavirus, Nu-papillomavirus, Xi-papillomavirus, Omikron-papillomavirus and Pi-papillomavirus. In a particular embodiment, papillomaviruses having a human tropism, such as types from genus Alpha-papillomavirus, Beta-papillomavirus, Gamma-papillomavirus, Mu-papillomavirus or Nu-papillomavirus, are preferred. In a particular embodiment, the heterologous polypeptide comprises or consists of antigens from HPV types of the Alpha-papillomavirus genus, especially a type from HPV species 7 and 9 of the Alpha-papillomavirus genus [17]. Thus, the heterologous polypeptide comprises or consists of antigens from HPV highly oncogenic type species, such as HPV16, HPV18, HPV31, HPV33, HPV35, HPV45, HPV52 or HPV58.

In a particular embodiment of a chimeric protein comprising HPV antigen(s) or epitope(s), said antigen(s), contained in the heterologous polypeptide, is or are selected from the E1, E2, E4, E5, E6 and E7 proteins of HPV or any antigenic fragment thereof.

In a particular embodiment, said antigen, contained in the heterologous polypeptide, is the E7 protein of a HPV type or said antigens, contained in the heterologous polypeptide, are the E7 proteins of different HPV types, or any antigenic fragment of this E7 protein (also called E7 fragment). In a preferred embodiment, the E7 protein or fragment thereof is from the HPV16 type (SEQ ID NO:25), the HPV18 type (SEQ ID NO:26), the HPV31 type (SEQ ID NO:27), the HPV33 type (SEQ ID NO:28), the HPV45 type (SEQ ID NO:29), the HPV52 type (SEQ ID NO:30) or the HPV58 type (SEQ ID NO:32). To remove a naturally human autoimmune epitope identified by the inventors in the E7 protein of the HPV52 type (as set forth in SEQ ID NO: 30), the amino acid residue in positions 84 and 86 have been substituted (M->L at position 84 and L->M at position 86); this modified sequence of the E7 protein of the HPV52 type is as set forth in SEQ ID NO:31 and is as such part of the invention.

In a particular embodiment, said heterologous polypeptide comprises or consists of at least 3 fragments (antigenic fragments) of an E7 protein of a HPV type, at least 3 of these fragments originating from E7 proteins of different HPV types. In this embodiment, "at least 3 fragments" means 3, 4, 5, 6, 7, 8, 9 or 10 fragments, provided that among these 3, 4, 5, 6, 7, 8, 9 or 10 fragments, at least 3, originate from different HPV types. In a preferred embodiment, said heterologous polypeptide comprises or consists of 6 E7 fragments, 3 of which originate from three different HPV types. In another preferred embodiment, said heterologous polypeptide comprises or consists of 8 E7 fragments, 4 of which originate from four different HPV types.

In a particular embodiment, all the E7 fragments originate from different HPV types. In another embodiment, only some E7 fragments (at least 3) originate from different HPV types, the other E7 fragments either all originate from one of said different HPV types, originate from two of said different HPV types, originate from three of said different HPV types, originate from four of said different HPV types or originate from five of said different HPV types. In a particular embodiment, the heterologous polypeptide comprises or consists of at least 4 fragments of the E7 protein, at least 3 of these E7 fragments originating from E7 proteins of different HPV types, and at least 2 of these E7 fragments originating from the same E7 protein of a HPV type (one E7 fragment being both in the group of the E7 fragment of different HPV types and in the group of the E7 fragment of the same HPV type). As a non-limitative example, for a heterologous polypeptide with 6 E7 fragments of HPV types, the following combinations may be found: a) 1 E7 fragment from a first HPV type, 1 E7 fragment from a second HPV type, and 4 E7 fragment from a third HPV type; b) 1 E7 fragment from a first HPV type, 2 E7 fragment from a second HPV type, and 3 E7 fragment from a third HPV type; and c) 2 E7 fragment from a first HPV type, 2 E7 fragment from a second HPV type, and 2 E7 fragment from a third HPV type.

In a particular embodiment, said E7 fragment of HPV type consists of the N-terminal-part of the E7 protein or of the C-terminal-part of the E7 protein.

By "N-terminal part of E7", it is meant a fragment the sequence of which is at least the first 25%, the first 30%, the first 35%, the first 40% of the E7 protein and is at most the first 50% of the length in amino acid residues of the E7 protein starting from the first N-terminal amino acid residue. Accordingly by "the first 25%", it is meant a polypeptide the sequence of which begins at residue 1 of the E7 protein and ends at the residue corresponding to 25% of the size of the full-length E7 protein. In a particular embodiment, a fragment consisting of the N-terminal-part of the E7 protein consists of a sequence which ranges from the first 28% to the first 31% of the E7 protein. In another embodiment, a fragment consisting of the N-terminal-part of the E7 protein consists of a sequence which ranges from the first 31% to the first 41% of the E7 protein. Particular embodiments are a fragment consisting of residues 1 to 29 of SEQ ID NO:25, a fragment consisting of residues 1 to 31 of SEQ ID NO:26, a fragment consisting of residues 1 to 28 of SEQ ID NO:27, a fragment consisting of residues 1 to 29 SEQ ID NO:28, a fragment consisting of residues 1 to 32 of SEQ ID NO:29, a fragment consisting of residues 1 to 29 of SEQ ID NO:31 or a fragment consisting of residues 1 to 29 of SEQ ID NO:32. Other embodiments are a fragment consisting of residues 1 to 34 of SEQ ID NO:25, a fragment consisting of residues 1 to 42 of SEQ ID NO:26, a fragment consisting of residues 1 to 32 of SEQ ID NO:27, a fragment consisting of residues 1 to 31 of SEQ ID NO:28, a fragment consisting of residues 1 to 37 of SEQ ID NO:29, a fragment consisting of residues 1 to 31 of SEQ ID NO:31 or a fragment consisting of residues 1 to 31 of SEQ ID NO:32.

By "C-terminal part of E7", it is meant a fragment the sequence of which is at least the last 25%, the last 30%, the last 40%, the last 50%, the last 60 of the length in amino acid residues of the E7 protein starting from the last amino acid residue and is at most the last 70% or the last 80% of the E7 protein. By "the last 25%", it is meant a polypeptide the sequence of which ends at the last residue of the E7 protein and begins at the residue corresponding to 25% of the size of the full-length E7 protein. In a particular embodiment, a fragment consisting of the C-terminal-part of the E7 protein consists of a sequence which ranges from the last 55% to the last 61% of the E7 protein. In another embodiment, a fragment consisting of the C-terminal-part of the E7 protein consists of a sequence which ranges from the last 60% to the last 70% of the E7 protein. Particular embodiments are a fragment consisting of residues 43 to 98 of SEQ ID NO:25, a fragment consisting of residues 43 to 105 of SEQ ID NO:26, a fragment consisting of residues 42 to 98 of SEQ ID NO:27, a fragment consisting of residues 43 to 97 SEQ ID NO:28, a fragment consisting of residues 44 to 106 of SEQ ID NO:29, a fragment consisting of residues 45 to 99 of SEQ ID NO:31 or a fragment consisting of residues 44 to 98 of SEQ ID NO:32. Other embodiments are a fragment consisting of residues 35 to 98 of SEQ ID NO:25, a fragment consisting of residues 43 to 105 of SEQ ID NO:26, a fragment consisting of residues 33 to 98 of SEQ ID NO:27, a fragment consisting of residues 32 to 97 of SEQ ID NO:28, a fragment consisting of residues 38 to 106 of SEQ ID NO:29, a fragment consisting of residues 32 to 99 of SEQ ID NO:31 or a fragment consisting of residues 32 to 98 of SEQ ID NO:32.

In a particular embodiment, said heterologous polypeptide comprises a N-terminal fragment and a C-terminal fragment as defined herein of the E7 protein of the same HPV type. In a particular embodiment, when said heterologous polypeptide comprises a N-terminal fragment and a C-terminal fragment of the E7 protein of the same HPV type (not fused), the sum of the size of the N-terminal-part of and of the size of the C-terminal-part does not exceed the size of the full-length E7 protein.

In another embodiment, said heterologous polypeptide comprises a N-terminal fragment and a C-terminal fragment as defined herein of the E7 protein of a first HPV type, a N-terminal fragment and a C-terminal fragment as defined herein of the E7 protein of a second HPV type, a N-terminal fragment and a C-terminal fragment as defined herein of the E7 protein of a third HPV type and, optionally, a N-terminal fragment and a C-terminal fragment as defined herein of the E7 protein of a fourth HPV type. These N-terminal and C-terminal fragments may be respectively grouped in the polypeptides. Furthermore they may be inverted with respect to their position in the native E7 protein, the C-terminal fragments being located upstream from the N-terminal one.

Thus, a chimeric protein of the invention comprises a heterologous polypeptide which comprises or consists of, from N-terminal to C terminal, (i) the C-terminal part of the E7 protein of a first HPV type, the C-terminal part of the E7 protein of a second HPV type, the C-terminal part of the E7 protein of a third HPV type, optionally the C-terminal part of the E7 protein of a fourth HPV type, and (ii) the N-terminal part of the E7 protein of said first HPV type, the N-terminal part of the E7 protein of said second HPV type, the N-terminal part of the E7 protein of said third HPV type, and optionally the N-terminal part of the E7 protein of said fourth HPV type.

The term "optionally" in the above definition refers to the presence of the fourth valence of HPV. Accordingly, the chimeric protein comprises both C-terminal part and N-terminal part of E7 proteins of a first a second and a third HPV as defined above, and optionally C-terminal part and N-terminal part of a fourth E7 protein of a different HPV.

In a particular embodiment, the different E7 fragments are either fused or are separated by peptide linkers or at least two of the E7 fragments are fused whereas at least two of the E7 fragments are separated by a peptide linker. In a particular embodiment, said peptide linker has a size ranging from 2 to 10 residues. In a particular embodiment, said linker is the dipeptide AS. The linkers may be added to separate each fragment or some fragments, and/or to improve immune response. In a particular embodiment, a dipeptide AS is added immediately upstream to the C-terminal part of a E7 fragment of HPV. In a particular embodiment, a dipeptide AS is added immediately upstream of the C-terminal part of an E7 fragment of HPV18 type, and in particular only upstream of this fragment.

A particular chimeric protein of the invention comprises or consists of a heterologous polypeptide which consists of, from N-terminal to C-terminal, the C-terminal part of the E7 protein of a first HPV type, fused to the C-terminal part of the E7 protein of a second HPV type, fused to the C-terminal part of the E7 protein of a third HPV type, fused to the N-terminal part of the E7 protein of said first HPV type, fused to the N-terminal part of the E7 protein of said second HPV type, fused to the N-terminal part of the E7 protein of said third HPV type.

Another particular chimeric protein of the invention comprises or consists of a heterologous polypeptide which consists of, from N-terminal to C terminal, the C-terminal part of the E7 protein of a first HPV type, fused to the C-terminal part of the E7 protein of a second HPV type, fused to the C-terminal part of the E7 protein of a third HPV type, fused to the C-terminal part of the E7 protein of a fourth HPV type, fused to the N-terminal part of the E7 protein of said first HPV type, fused to the N-terminal part of the E7 protein of said second HPV type, fused to the N-terminal part of the E7 protein of said third HPV type, fused to the N-terminal part of the E7 protein of said fourth HPV type.

In the particular embodiment of a chimeric protein described herein, said first, second and third HPV types are HPV16, HVP18 and HPV45 types. In a particular embodiment, said first, second and third HPV types are HPV16, HVP18 and HPV45 types, and an AS dipeptide is added immediately upstream of the C-terminal part of the E7 fragment of HPV18 type. In another embodiment, said first, second and third HPV types are HPV31, HPV52 and HPV58 types. In another embodiment, said first, second and third HPV types are HPV31, HVP33 and HPV52 types. In another embodiment, said first, second, third and fourth HPV types are HPV31, HPV33, HPV52 and HPV58 types. In another embodiment, said first, second, third and fourth HPV types are HPV16, HVP18, HPV33 and HPV45 types. In another embodiment, said first, second, third and fourth HPV types are HPV16, HVP18, HPV45 and HPV58 types. In another embodiment, said first, second, third and fourth HPV types are HPV16, HVP18, HPV33 and HPV45 types and an AS dipeptide is added immediately upstream of the C-terminal part of the E7 fragment of HPV18 type. In another embodiment, said first, second, third and fourth HPV types are HPV16, HVP18, HPV45 and HPV58 types, and an AS dipeptide is added immediately upstream of the C-terminal part of the E7 fragment of HPV18 type.

In a particular embodiment, the N-terminal-part of the E7 protein of a HPV type consists of a sequence which ranges from the first 28% to the first 31% of the E7 protein and the C-terminal-part of the E7 protein of said same HPV type consists of a sequence which ranges from the last 55% to the last 61% of the E7 protein. Examples of N-terminal-part/C-terminal-part pairs of the E7 protein of the same HPV type, whatever their arrangement within said heterologous polypeptide, and in particular according to the arrangement described herein, are as follows:

residues 1 to 29 of SEQ ID NO:25/residues 43 to 98 of SEQ ID NO:25;
residues 1 to 31 of SEQ ID NO:26/residues 43 to 105 of SEQ ID NO:26;
residues 1 to 28 of SEQ ID NO:27/residues 42 to 98 of SEQ ID NO:27;
residues 1 to 29 SEQ ID NO:28/residues 43 to 97 SEQ ID NO:28;
residues 1 to 32 of SEQ ID NO:29/residues 44 to 106 of SEQ ID NO:29;
residues 1 to 29 of SEQ ID NO:31/residues 45 to 99 of SEQ ID NO:31; and
residues 1 to 29 of SEQ ID NO:32/residues 44 to 98 of SEQ ID NO:32.

In another embodiment, the N-terminal-part of the E7 protein of a HPV type consists of a sequence which ranges from the first 31% to the first 41% of the E7 protein and the C-terminal-part of the E7 protein consists of a sequence which ranges from the last 60% to the last 70% of the E7 protein. In particular embodiment, the sum of the size of the N-terminal-part of the E7 protein and the size of the size of the C-terminal-part is at most 100% of the size of the E7 protein. In that case, the entire E7 protein (in two fragments), may be contained in the heterologous polypeptide. Examples of N-terminal-part/C-terminal-part pairs of the E7 protein of the same HPV type, whatever their arrangement within said heterologous polypeptide, and in particular according to the arrangement described herein, are as follows:

residues 1 to 34 of SEQ ID NO:25/residues 35 to 98 of SEQ ID NO:25;
residues 1 to 42 of SEQ ID NO:26/residues 43 to 105 of SEQ ID NO:26;
residues 1 to 32 of SEQ ID NO:27/residues 33 to 98 of SEQ ID NO:27;
residues 1 to 31 of SEQ ID NO:28/residues 32 to 97 of SEQ ID NO:28;
residues 1 to 37 of SEQ ID NO:29/residues 38 to 106 of SEQ ID NO:29;
residues 1 to 31 of SEQ ID NO:31/residues 32 to 99 of SEQ ID NO:31; and
residues 1 to 31 of SEQ ID NO:32/residues 32 to 98 of SEQ ID NO:32.

In a particular embodiment of a chimeric protein, when said first, second and third HPV types are HPV16, HVP18 and HPV45 types, the heterologous polypeptide consists either of the sequence as set forth in SEQ ID NO:34 (encoded by a polynucleotide as set forth in SEQ ID NO:33) or the sequence as set forth in SEQ ID NO:36 (encoded by a polynucleotide as set forth in SEQ ID NO:35).

In a particular embodiment of a chimeric protein, when said first, second and third HPV types are HPV31, HVP52 and HPV58 types, the heterologous polypeptide consists either of the sequence as set forth in SEQ ID N042: (encoded by a polynucleotide as set forth in SEQ ID NO:41) or the sequence as set forth in SEQ ID NO:44 (encoded by a polynucleotide as set forth in SEQ ID NO:43).

In a particular embodiment of a chimeric protein, when said first, second and third HPV types are HPV31, HVP33 and HPV52 types, the heterologous polypeptide consists either of the sequence as set forth in SEQ ID NO:46 (encoded by a polynucleotide as set forth in SEQ ID NO:45) or the sequence as set forth in SEQ ID NO:48 (encoded by a polynucleotide as set forth in SEQ ID NO:47).

In a particular embodiment of a chimeric protein, when said first, second, third and fourth HPV types are HPV31, HPV33, HPV52 and HPV58 types, the heterologous polypeptide consists either of the sequence as set forth in SEQ ID NO:38 (encoded by a polynucleotide as set forth in SEQ ID NO:37) or the sequence as set forth in SEQ ID NO:40 (encoded by a polynucleotide as set forth in SEQ ID NO:39).

In a particular embodiment of a chimeric protein, when said first, second, third and fourth HPV types are HPV16, HVP18, HPV33 and HPV45 types, the heterologous polypeptide consists either of the sequence as set forth in SEQ ID NO:50 (encoded by a polynucleotide as set forth in SEQ ID NO:49) or the sequence as set forth in SEQ ID NO:52 (encoded by a polynucleotide as set forth in SEQ ID NO:51).

In a particular embodiment of a chimeric protein, when said first, second, third and fourth HPV types are HPV16, HVP18, HPV45 and HPV58 types, the heterologous polypeptide consists either of the sequence as set forth in SEQ ID NO:54 (encoded by a polynucleotide as set forth in SEQ ID NO:53) or the sequence as set forth in SEQ ID NO:56 (encoded by a polynucleotide as set forth in SEQ ID NO:55).

The invention also concerns a polypeptide, comprising or consisting of, from N-terminal to C terminal, the C-terminal part of the E7 protein of a first HPV type, the C-terminal part of the E7 protein of a second HPV type, the C-terminal part of the E7 protein of a third HPV type, optionally the C-terminal part of the E7 protein of a fourth HPV type, the N-terminal part of the E7 protein of said first HPV type, the N-terminal part of the E7 protein of said second HPV type, the N-terminal part of the E7 protein of said third HPV type, and optionally the N-terminal part of the E7 protein of said fourth HPV type. Definitions provided herein for a heterologous polypeptide contained in a chimeric protein of the invention apply identically to the polypeptide as such, in particular regarding the definitions of the N-terminal part of the E7 protein of a HPV type, of the C-terminal part of the E7 protein of a HPV type, the optional presence of a linker, in particular the AS dipeptide, the nature of the HPV types, the particular fragments of the E7 proteins from SEQ ID NO:25, 26, 27, 28, 29, 31 and 32. Definitions provided herein for a composition comprising chimeric protein(s) of the invention apply identically to the polypeptides as such, in particular regarding the general or specific combinations of said first, second, third, fourth, fifth and sixth HPV types and, when applicable, of said seventh HPV type.

In a particular embodiment, said polypeptide consists of a sequence as set forth in SEQ ID NO: 34, 36, 38, 40, 42, 44, 46, 48, 50, 52, 54 or 56. The invention is also directed to the polynucleotides encoding these polypeptides, in particular the polynucleotides as set forth in SEQ ID NO: 33, 35, 37, 39, 41, 43, 45, 47, 49, 51, 53 and 55, as well as a vector comprising these polynucleotides, and a cell or cell culture comprising these polynucleotide or a vector comprising these polynucleotides; all as defined herein.

Despite its size (more than 200 residues), its complexity (presence of several cysteine residues) and its negative electrostatic charge, said polypeptide has been surprisingly shown to be efficiently translocated into the cytosol of antigen presenting cells, enabling to obtain strong and large T-cell immune responses.

In a particular embodiment, the invention is directed to a chimeric protein of the invention which comprises or consists of a sequence as set forth in SEQ ID NO:58 or in SEQ ID NO:61. These chimeric proteins are respectively encoded by a polynucleotide the sequence of which is as set forth in SEQ ID NO:57 or in SEQ ID NO:60. In a particular embodiment, the chimeric protein of SEQ ID NO:58 or SEQ ID NO:61 is expressed from the plasmids whose sequence is SEQ ID NO:59 or SEQ ID NO:62 respectively.

In a particular embodiment, the invention is also directed to a chimeric protein of the invention comprises or consists of a sequence as set forth in SEQ ID NO:64 or in SEQ ID NO:67. These chimeric proteins are respectively encoded by a polynucleotide the sequence of which is as set forth in SEQ ID NO:63 or in SEQ ID NO:66. In a particular embodiment, the chimeric protein of SEQ ID NO:64 or SEQ ID NO:67 are expressed from the plasmids whose sequence is SEQ ID NO:65 and SEQ ID NO:68 respectively.

Thus, any chimeric protein of the invention comprising a heterologous polypeptide comprising or consisting of at least one antigen(s) or at least one epitope(s) originating from HPV, as described herein, may be expressed, using the plasmids of SEQ ID NO:59, SEQ ID NO:62, SEQ ID NO:65 and SEQ ID NO:68, as expression vectors. In this order, the polynucleotide contained between nucleotides 904 and 1731 of SEQ ID NO:59 is removed, and replaced by a polynucleotide encoding a heterologous polypeptide of the invention, enabling to express a chimeric protein of the invention comprising this heterologous polypeptide. Similarly, the polynucleotide contained between nucleotides 772 and 1599 of SEQ ID NO:62 is removed, and replaced by a polynucleotide encoding a heterologous polypeptide of the invention, enabling to express a chimeric protein of the invention comprising this heterologous polypeptide. Similarly, the polynucleotide contained between nucleotides 904 and 1836 of SEQ ID NO:65 is removed, and replaced by a polynucleotide encoding a heterologous polypeptide of the invention, enabling to express a chimeric protein of the invention comprising this heterologous polypeptide. Similarly, the polynucleotide contained between nucleotides 772 and 1704 of SEQ ID NO:68 is removed, and replaced by a polynucleotide encoding a heterologous polypeptide of the invention, enabling to express a chimeric protein of the invention comprising this heterologous polypeptide.

In a particular embodiment of the invention, the polynucleotide contained between nucleotides 904 and 1731 of SEQ ID NO:59 is removed, and replaced by a polynucleotide encoding a heterologous polypeptide of the invention derived from a unique HPV E7 protein this polynucleotide being selected among the polynucleotides encoding the polypeptides having respectively the sequence of SEQ ID NO:70, SEQ ID NO:71, SEQ ID NO:74, SEQ ID NO:73 and SEQ ID NO:72, Such constructs enable to express a monovalent chimeric protein of the invention comprising a heterologous polypeptide having SEQ ID NO:70, SEQ ID NO:71, SEQ ID NO:74, SEQ ID NO:73 or SEQ ID NO:72 and representing respectively HPV31 E7 deleted for its acidic region, HPV33 E7 deleted for its acidic region, HPV58 E7 deleted for its acidic region, HPV52 E7 deleted for its acidic region and HPV45 E7 deleted for its acidic region.

In a particular embodiment, of the invention, the polynucleotide contained between nucleotides 904 and 1731 of SEQ ID NO:59 is removed, and replaced by a polynucleotide encoding a heterologous polypeptide of the invention derived from a unique HPV E7 protein this polynucleotide being selected among the polynucleotides having respectively the sequence of SEQ ID NO:75, SEQ ID NO:76, SEQ ID NO:79, SEQ ID NO:78 and SEQ ID NO:77.

The invention is also directed to a composition comprising at least one, preferably one or two, chimeric protein(s) of the invention, in particular at least two, preferably two, different chimeric proteins of the invention, In a particular embodiment, when the composition comprises more than one different, preferably 2 different, chimeric proteins, the sequences of the CyaA portions (or fragments) of said chimeric proteins are the same or are different, whereas the sequences of the heterologous polypeptides are different. In a particular embodiment, the different, preferably 2 different, chimeric proteins are selected from the different chimeric proteins as described herein. In a particular embodiment, the 2 different chimeric proteins are either:

1) 2 chimeric proteins comprising or consisting of, from N-terminal to C-terminal, (a) a fragment consisting of residues 1 to 227 of SEQ ID NO:2 (b) a heterologous polypeptide comprising at least 3 HPV antigens, each HPV antigen originating from a different HPV type; and (c) a fragment consisting of residues 321 to 1706 of SEQ ID NO:2, provided that the heterologous polypeptides of these two chimeric proteins differ in their sequence and the HPV types; or 2) 2 chimeric proteins comprising or consisting of, from N-terminal to C-terminal, (a) a fragment consisting of residues 1 to 183 of SEQ ID NO:2, (b) a heterologous polypeptide comprising at least 3 HPV antigens, each HPV antigen originating from a different HPV type, and (c) a fragment consisting of residues 387 to 1706 of SEQ ID NO:2, provided that the heterologous polypeptides of these two chimeric proteins differ in their sequence and the HPV types.

In another embodiment, the sequences of the CyaA portions (or fragments) of said different, preferably 2 different, chimeric proteins are different and the sequence of the heterologous polypeptide is different. In a particular embodiment, the different, preferably 2 different types of chimeric proteins are selected from the different, chimeric proteins as described herein. In a particular embodiment, at least one, preferably one, of the different, preferably 2 different, chimeric proteins comprise or consists of, from N-terminal to C-terminal, (a) a fragment consisting of residues 1 to 227 of SEQ ID NO:2 (b) a heterologous polypeptide comprising at least 3 HPV antigens, each HPV antigen originating from a different HPV type; and (c) a fragment consisting of residues 321 to 1706 of SEQ ID NO:2, and at least one, preferably one, of the different, preferably 2 different, chimeric proteins comprise or consists of, from N-terminal to C-terminal, (a) a fragment consisting of residues 1 to 183 of SEQ ID NO:2, (b) a heterologous polypeptide comprising at least 3 HPV antigens, each HPV antigen originating from a different HPV type, wherein said heterologous polypeptide differs in its sequence and HPV types from the heterologous polypeptide of the other at least one chimeric protein; and (c) a fragment consisting of residues 387 to 1706 of SEQ ID NO:2.

In a particular embodiment of a composition comprising more than one different, preferably 2 different types of chimeric proteins, the heterologous polypeptides are as defined herein. In a particular embodiment, each heterologous polypeptide comprises a N-terminal fragment and a C-terminal fragment as defined herein of the E7 protein of a first HPV type, a N-terminal fragment and a C-terminal fragment as defined herein of the E7 protein of a second HPV type, a N-terminal fragment and a C-terminal fragment as defined herein of the E7 protein of a third HPV type and, optionally, a N-terminal fragment and a C-terminal fragment as defined herein of the E7 protein of a fourth HPV type, wherein each heterologous polypeptide has a sequence which is different from the other(s) heterologous polypeptide(s).

In a particular embodiment, the composition comprising 2 different types of chimeric proteins, the heterologous polypeptide of the first type of chimeric protein comprising a N-terminal fragment and a C-terminal fragment as defined herein of the E7 protein of a first HPV type, a N-terminal fragment and a C-terminal fragment as defined herein of the E7 protein of a second HPV type and a N-terminal fragment and a C-terminal fragment as defined herein of the E7 protein of a third HPV type, and the heterologous polypeptide of the second type of chimeric protein comprising a N-terminal fragment and a C-terminal fragment as defined herein of the E7 protein of a fourth HPV type, a N-terminal fragment and a C-terminal fragment as defined herein of the E7 protein of a fifth HPV type and a N-terminal fragment and a C-terminal fragment as defined herein of the E7 protein of a sixth HPV type, wherein the first, second, third, fourth, fifth and sixth HPV types are different HPV types.

In a particular embodiment, the first, second, third, fourth, fifth and sixth HPV types are (a) chosen among HPV16, HPV18, HPV45, HPV31, HPV52 and HPV58 or (b) chosen among HPV16, HPV18 and HPV45, HPV31, HPV33 and HPV52.

In a particular embodiment, the first, second and third HPV types are HPV16, HPV18 and HPV45. In a particular embodiment, the heterologous polypeptide comprises or consists of the sequence as set forth in SEQ ID NO:34 or 36. In a particular embodiment, said chimeric protein comprises or consists of the sequence as set forth in SEQ ID NO: 58, 61, 64 or 67. To these particular embodiments, a fourth HPV subtype can be associated, which is chosen among HPV33 or HPV58.

In a particular embodiment, independently or in combination with the embodiment regarding the first, second and third HPV types, the fourth, fifth and sixth HPV types are HPV31, HPV52 and HPV58. In a particular embodiment, the heterologous polypeptide comprises or consists of the sequence as set forth in SEQ ID NO:42 or 44.

In a particular embodiment, independently or in combination with the embodiment regarding the first, second and third HPV types, the fourth, fifth and sixth HPV types are HPV31, HPV33 and HPV52. In a particular embodiment, the heterologous polypeptide comprises or consists of the sequence as set forth in SEQ ID NO:46 or 48. In a particular embodiment, said chimeric protein comprises or consists of the sequence as set forth in SEQ ID NO: 58, 61, 64 or 67, into which the sequence as set forth in SEQ ID NO: 34 or 36 has been replaced by the sequence as set forth in SEQ ID NO: 42, 44, 46 or 48.

The invention relates in a particular embodiment, to the combination of the above recited antigens of the specified HPV subtypes, when these antigens are provided in the chimeric proteins in an order corresponding to above specified order of citation of the HPV subtypes or alternatively in any other order of presentation of the antigens in the chimeric proteins that would correspond to any combination of first, second, third, and optionally fourth HPV among those cited and in particular among the groups of HPV16, HPV18 and HPV45 or HPV31, HPV52 and HPV58 or HPV31, HPV33 and HPV52.

In a particular embodiment, the first, second, third, fourth, fifth and sixth HPV types are (a) HPV16, HPV18, HPV45, HPV31, HPV52 and HPV58 respectively or (b) HPV16, HPV18 and HPV45, HPV31, HPV33 and HPV52 respectively.

In a particular embodiment, the two different chimeric proteins comprise the antigens as disclosed herein of the HPV16, HPV18, HPV45 for the first chimeric protein and of the HPV31, HPV52, HPV58 for the second chimeric protein. In another particular embodiment, the two different chimeric proteins comprise the antigens as disclosed herein of the HPV16, HPV18, HPV45 for the first chimeric protein and of the HPV31, HPV33, HPV52 for the second chimeric protein. In a preferred embodiment, but not necessarily, the HPV antigens thus defined are inserted in the chimeric proteins in the specified order.

In a particular embodiment, the composition comprising 2 different types of chimeric proteins, the heterologous polypeptide of the first type of chimeric protein comprising a N-terminal fragment and a C-terminal fragment as defined herein of the E7 protein of a first HPV type, a N-terminal fragment and a C-terminal fragment as defined herein of the E7 protein of a second HPV type and a N-terminal fragment, a C-terminal fragment as defined herein of the E7 protein of a third HPV type and a N-terminal fragment and a C-terminal fragment as defined herein of the E7 protein of a fourth HPV type, and the heterologous polypeptide of the second type of chimeric protein comprising a N-terminal fragment and a C-terminal fragment as defined herein of the E7 protein of a fifth HPV type, a N-terminal fragment and a C-terminal fragment as defined herein of the E7 protein of a sixth HPV type and a N-terminal fragment and a C-terminal fragment as defined herein of the E7 protein of a seventh HPV type, wherein the first, second, third, fourth, fifth, sixth and seventh HPV types are different HPV types.

In a particular embodiment, the first, second, third, fourth, fifth, sixth and seventh HPV types are selected from the group consisting of (a) HPV31, HPV33, HPV52, HPV58, HPV16, HPV18 and HPV45, (b) HPV16, HPV18, HPV33, HPV45, HPV31, HPV52 and HPV58, (c) HPV16, HPV18, HPV45, HPV58, HPV31, HPV52 and HPV33, (d) HPV16, HPV18, HPV33, HPV45, HPV31, HPV58 and HPV52 (e) HPV16, HPV18, HPV45, HPV58, HPV31, HPV33 and HPV52 and (f) HPV16, HPV18, HPV45, HPV33, HPV31, HPV52 and HPV58.

In a particular embodiment, the first, second, third and fourth HPV types are HPV16, HPV18, HPV33 and HPV45. In a particular embodiment, the heterologous polypeptide comprises or consists of the sequence as set forth in SEQ ID NO:50 or 52. In a particular embodiment, the first, second, third and fourth HPV types are HPV16, HPV18, HPV45 and HPV58. In a particular embodiment, the heterologous polypeptide comprises or consists of the sequence as set forth in SEQ ID NO:54 or 56. In a particular embodiment, the first, second, third and fourth HPV types are HPV31, HPV33, HPV52 and HPV58. In a particular embodiment, the heterologous polypeptide comprises or consists of the sequence as set forth in SEQ ID NO:40 or 42. In a particular embodiment, said first chimeric protein comprises or consists of the sequence as set forth in SEQ ID NO: 58, 61, 64 or 67, into which the sequence as set forth in SEQ ID NO: 34 or 36 has been replaced by the sequence as set forth in SEQ ID NO:40, 42, 50, 52, 54 or 56.

In a particular embodiment, independently or in combination with the embodiment regarding the HPV31, HPV33, HPV52 and HPV58 as the first, second, third and fourth HPV types, the fifth, sixth and seventh HPV types are HPV16, HPV18 and HPV45. In a particular embodiment, the heterologous polypeptide comprises or consists of the sequence as set forth in SEQ ID NO:34 or 36. In a particular embodiment, said second chimeric protein comprises or consists of the sequence as set forth in SEQ ID NO: 58, 61, 64 or 67.

In a particular embodiment, independently or in combination with the embodiment regarding the respectively HPV16, HPV18, HPV33 and HPV45 or the HPV16, HPV18, HPV45 and HPV58 as the first, second, third and fourth HPV types, the fifth, sixth and seventh HPV types are respectively HPV31, HPV52 and HPV58 or HPV31, HPV33, HPV52. In a particular embodiment, the heterologous polypeptide comprises or consists of the sequence as set forth in SEQ ID NO: 42 or 44. In a particular embodiment, independently or in combination with the embodiment regarding the respectively HPV16, HPV18, HPV33 and HPV45 or the HPV16, HPV18, HPV45 and HPV58 as the first, second, third and fourth HPV types, the fifth, sixth and seventh HPV types are respectively the HPV31, HPV52 and HPV58 or HPV31, HPV33 and HPV52. In a particular embodiment, the heterologous polypeptide comprises or consists of the sequence as set forth in SEQ ID NO: 46 or 48. In a particular embodiment, said second chimeric protein comprises or consists of the sequence as set forth in SEQ ID NO: 58, 61, 64 or 67, into which the sequence as set forth in SEQ ID NO: 34 or 36 has been replaced by the sequence as set forth in SEQ ID NO: 42, 44, 46 or 48.

In a particular embodiment, the first, second, third, fourth, fifth, sixth and seventh HPV types are selected from the group consisting of (a) HPV31, HPV33, HPV52, HPV58, HPV16, HPV18 and HPV45 respectively, (b) HPV16, HPV18, HPV33, HPV45, HPV31, HPV52 and HPV58 respectively, (c) HPV16, HPV18, HPV45, HPV58, HPV31, HPV52 and HPV33 respectively, (d) HPV16, HPV18, HPV33, HPV45, HPV31, HPV58 and HPV52 respectively and (e) HPV16, HPV18, HPV45, HPV58, HPV31, HPV33 and HPV52 respectively.

The invention relates in a particular embodiment, to the combination of the above recited antigens of the specified HPV subtypes, when these antigens are provided in the chimeric proteins in an order corresponding to above specified order of citation of the HPV subtypes or alternatively in any other order of presentation of the antigens in the chimeric proteins that would correspond to any combination of first, second, third, and when present fourth HPV among those cited and in particular among the groups of HPV16, HPV18, HPV33 and HPV45 or the group of HPV16, HPV18, HPV45 and HPV58 or the group of HPV31, HPV52 and HPV58 or the group of HPV31, HPV33 and HPV52.

In a particular embodiment, the two different chimeric proteins comprise the antigens as disclosed herein of the HPV16, HPV18, HPV45, HPV58 for the first chimeric protein and of the HPV31, HPV33, HPV52 for the second chimeric protein. In another particular embodiment the two different chimeric proteins comprise the antigens as disclosed herein of the HPV16, HPV18, HPV45, HPV33 for the first chimeric protein and of the HPV31, HPV52, HPV58 for the second chimeric protein. In another particular embodiment the two different chimeric proteins comprise the antigens as disclosed herein of the HPV31, HPV33, HPV52, HPV58 for the first chimeric protein and of the HPV16, HPV18, HPV45 for the second chimeric protein. In a preferred embodiment, but not necessarily, the HPV antigens thus defined are inserted in the chimeric proteins in the specified order.

In a particular embodiment, the composition also comprises a suitable pharmaceutical vehicle, which is for example selected from buffering agents, saline, phosphate buffered saline, dextrose, glycerol, water, ethanol and the like and combinations thereof.

In a particular embodiment, the composition, with or without suitable pharmaceutical vehicle, also comprises at least one adjuvant, preferably one adjuvant, and/or a surfactant and/or immunomodulatory substances (such as cytokines or chemokines) and/or growth factors such as GM-CSF. Various adjuvants are known in the art and include Complete Freund's Adjuvant (CFA), Incomplete Freund's Adjuvant (IFA), montanide ISA (incomplete seppic adjuvant), muramyl peptides such as muramyl dipeptide (MDP) MDP-Lys (L18) (N$^\alpha$-acetylemuramyl-L-alanyl-D-isoglutaminyl-N$^e$steoroyl-L-lysine), zinc sulphate, colloidal iron hydroxide, calcium phosphate or calcium chloride, CpG oligodeoxynucleotides (CPG ODN) such as CPG ODN 1826 and CPG ODN 2007, MF59 which is a detergent stabilized oil-in water emulsion containing 5% squalene (w/v), 0.5% Tween® 80 (w/v) and 0.5% Span (w/v) in water, TLR4 ligands (such as MPL, GLA) TLR3 ligands (such as Poly IC, Poly-ICLC called Hiltonol®), polysaccharides (such as Inulin) and liposomes (such as cationic liposomes, ISCOMs).

In a particular embodiment, at least one adjuvant is chosen among molecules which have the capacity to activate T-cell immune response. Preferred adjuvants are the ones that bind or are agonist to TLR (Toll like receptor) 3, 4, 7, 8 and/or 9 on immune cells (such as APC). In a particular embodiment, the adjuvant is a TLR ligand, in particular a TLR ligand selected from the group consisting of TLR ligands of class 3, such as poly-ICLC, TLR ligands of class 4, such as MPL TLR ligands of class 9, such as CpG, and TLR ligands of class 7/8, such as Imiquimod. Examples of adjuvants are Imiquimod and Poly-ICLC. A commercially available drug based on Imiquimod is Aldara™ (sold as a cream containing 5% Imiquimod) Poly-ICLC can be purchased from Oncovir Inc, (WA, US) as Hiltonol®.

In a particular embodiment, the chimeric protein(s) or compositions defined herein can be injected in a patient via different routes: subcutaneous (s.c.), intradermal (i.d.), intramuscular (i.m.) or intravenous (i.v.) injection, oral administration and mucosal administration, especially intranasal administration or inhalation. In a particular embodiment, the chimeric protein(s) or compositions defined herein is/are administered intradermally.

Moreover, the chimeric protein(s) or the composition as defined herein may be combined or mixed with at least one immunopotentiator, such as at least one adjuvant, preferably one adjuvant, and/or a surfactant and/or immunomodulatory substances. By "combined", it is meant that the chimeric protein(s) or the composition as defined herein and the immunopotentiator are both put in contact with the host, at the same or different time and/or by the same or different modes of administration, preferably at the same site of contact. In contrast, "mixed" means that the chimeric protein (s) or the composition as defined herein and the immunopotentiator are in the same formulation when administered.

The chimeric protein(s) or compositions defined herein may be in a solid form (capsule, powder, tablet, pill, suppository, quick release tablet, gastro-resistant tablet, delayed release tablet), a powder form, preferably after lyophilization (lyophilized form or lyophilized powder form) which needs to be reconstituted for example with diluents(s) before injection, or in a liquid form, such as an injectable solution or injectable suspension.

The quantity of chimeric protein(s) to be administered (dosage) depends upon the subject to be treated, including considering the condition of the patient, the state of the individual's immune system, the route of administration and the weight of the host. The conventional dosages range from 1 to 2400 µg, 100 to 2000 µg, 200 to 1000 µg, 500 to 1000 µg. A particular dosage is selected from the group consisting of 100, 200, 300, 400, 500, 600, 700, 800, 900, 1000, 1500, 2000 or 2400 µg±10%. In another embodiment, conventional dosages range from 1 to 100 µg, 1 to 50 µg and 1 to 10 µg of vector-carried polypeptide(s). The total dose for the whole treatment with the active ingredient of the invention ranges from 200 to 2400 µg, 300 to 2000 µg, 400 to 1000 µg, 500 to 800 µg. These examples can be modified by one skilled in the art, depending on circumstances.

The invention is also directed to a chimeric protein of the invention or a composition of the invention, for use as a medicament. In a particular embodiment, the chimeric protein of the invention or the composition of the invention is for use in the prophylaxis or treatment of a pathogen infection. In another embodiment, the chimeric protein of the invention or the composition of the invention is for use in the prophylaxis or treatment of an oncogenic-, preferably oncogenic tumour-, based disorder, such as tumoural disorder, malignant tumour disorder or malignant neoplasm. In a particular embodiment, the chimeric protein of the invention or the composition of the invention is for use in the induction of a prophylactic immune response or of a therapeutic immune response In a particular embodiment, the invention also relates to a method for the therapeutic treatment of an animal or a human patient presenting with a pathogen infection or suspected to have a pathogen infection comprising (a) the administration of a chimeric protein or a composition of the invention into said animal or human patient, possibly as multiple administered doses, and (b) the follow up of the condition of said animal or human patient.

In another embodiment, the invention also relates to a method for the therapeutic treatment of an animal or a human patient presenting with tumour disorders comprising (a) the administration of a chimeric protein or a composition of the invention into said animal or human patient, possibly as multiple administered doses, and (b) the follow up of the condition of said animal or human patient.

The invention also relates to a method to prevent a pathogen infection of an animal or a human patient comprising (a) the administration of a chimeric protein or a composition of the invention into said animal or human patient, possibly as multiple administered doses, and (b) the follow up of the condition of said animal or human patient, possibly as multiple administered doses.

The invention also relates to a method to prevent the apparition or development of tumour disorders in an animal or a human patient comprising (a) the administration of a chimeric protein or a composition of the invention into said animal or human patient, possibly as multiple administered doses, and (b) the follow up of the condition of said animal or human patient.

A therapeutic treatment according to the invention aims at improving the clinical condition of an animal or a human patient in need thereof, who has been diagnosed as being infected or suspected to be infected by a pathogen or as suffering from a pathological state. In a particular embodiment, this treatment aims at the elimination of the causative agent or organism of the disease, or at lowering the abundance of said agent or organism. In a situation of viral infection, the treatment may result in a significant decrease of the viral load in the targeted tissues of the host that is less than what can be detected when measured. In case of tumoural disorders, the treatment may result at lowering the size or the development of the tumour(s), or at eradicating the tumour cells, or at reducing the number of tumour cells at a level which is less than what can be detected when measured. The therapeutic treatment also aims at improving the clinical status of the animal or human patient, by eliminating or lowering the symptoms associated with the pathogen infection or the tumour disorders, and preferably aims at restoring health.

A prophylactic treatment of an animal or a human patient aims at preventing the pathogen infection of said animal or a human patient, or preventing the apparition or development of neoplastic tumoural disorders, or preventing the occurrence of a pathological state in said animal or human patient. The prophylactic treatment encompasses vaccination.

Therapeutic and prophylactic treatments, using a chimeric protein or a composition of the invention, are based on the elicitation of an efficient immune response, preferably a cellular immune response, against the epitope(s) contained in the heterologous polypeptide in the host.

Therefore, the invention is also directed to the use of a chimeric protein or a composition of the invention to induce or elicit an immune response, preferably a cellular immune response (such a CTL response) against the epitope(s) contained in the heterologous polypeptide, in the host into which said chimeric protein or composition is administered.

In a particular embodiment, the invention is also directed to a chimeric protein or composition of the invention for use (i) in the immunotherapeutic treatment of first determined pathological condition(s) diagnosed in a mammalian host by eliciting a T cell immune response against a first group of epitopes contained in the heterologous polypeptide and (ii) in the prophylaxis against second determined pathological condition(s) in the same mammalian host by eliciting a T cell memory immune response against a second group of epitopes contained in said heterologous polypeptide, said immune responses being obtained after administration of said chimeric protein or said composition into said host, wherein said prophylaxis against second determined pathological condition(s) is not observed when said second group of epitopes is not contained in said heterologous polypeptide.

Indeed, the inventors have shown that the chimeric protein of the invention enables to bypass the competition existing between different epitopes, either regarding access to APC, processing and presentation by APC and availability of cytokines. Thus, using the chimeric protein of the invention, it is possible to induce an immune response against the first group of epitopes within a therapeutic treatment and to induce also an immune response induced against the second group of epitopes within a prophylactic treatment. Thus, the chimeric protein of the invention is efficient to elicit a T cell immune response within an immunotherapeutic treatment of first determined pathological condition(s) diagnosed in a host and to elicit a T cell memory immune response within the prophylaxis against the risk of second determined pathological condition(s) in the same host.

EXAMPLES

I. Material and Methods

Mice

Six weeks-old female C57BL/6 mice (H-$2^b$) were purchased from Janvier Laboratories. Mice were housed under pathogen-free conditions with water and food ad libitum. Procedures involving animals and their care were conformed to Genticel guidelines that comply with national and international laws and policies and that are reviewed by the local ethical committee.

For some of the HPV types used in the present invention, other mice may be advantageously used, which have a different genetic background. Such mice may be purchased from Janvier laboratories and include DBA/2JRi (H2K$^d$/H2D$^d$), or CBA/JRi (H2K$^k$/H2D$^k$) SJL/JRi (H2K$^S$/H2D$^S$) and FVB/NRi (H2K$^d$/H2D$^d$).

Other mice such as humanized mice having a HLA, in particular HLA-A2 haplotype are also of interest in determining the immune response elicited by the constructs of the invention. Transgenic HLA-A2.1 mice can be purchased from TACONIC (USA) to test the immunogenicity of the described vaccine candidates against each E7 from selected HPV types in mice expressing the human HLA-A2.1 haplotype.

These mice are used to test the immunogenicity of the described candidate vaccines against each E7 from selected HPV types.

Tumour Cell Lines

TC-1 (tissue culture number one) tumour cells [19] were prepared by transformation of C57BL/6 primary mouse lung cells with HPV16 E6 and E7 oncogenes and activated human c-Ha-Ras oncogene. The cells used in this study have been obtained from the ATCC. TC1 cells were thawed before each experiment and were then cultured and expanded in vitro during at least 10 days before injection.

Lewis lung carcinoma (LL2) is a cell line established from the lung of a C57BL/6 mouse bearing a tumour resulting from an implantation of primary Lewis lung carcinoma (13). This line is widely used as a model for metastasis and is useful for studying the mechanisms of cancer therapy (14). LL2 tumour cell line was purchased from the ATCC (CRL-1642).

These cells were transduced with lentiviral vectors bearing HPV18 E7 and GFP genes or only the GFP gene according to the manufacturer's protocol (Vectalys, Labege, France). 3 clones were selected based on MHC class I, GFP, and E7 expression. One clone was selected following prophylactic in vivo selection according to its growth profile and its ability to be targeted by HPV18 E7-specific cytotoxic T CD8$^+$ lymphocytes; a take rate experiment was performed for optimal number of cells inoculation. In vivo selection, take rate and ideal time of treatment studies were performed by Oncodesign (Dijon, France). LL2 cells were thawed before each experiment and were then cultured and expanded in vitro during at least 10 days before injection.

B16-1RES-GFP-OVA (B16-GFP) and B16-MAGEA3-1RES-GFP-OVA (B16-MAGEA3-GFP) cells were used to re-stimulate ex vivo splenocytes obtained from treated mice. B16-MAGEA3 cells are B16-F10 syngeneic tumour cells transduced by Vectalys with to express the MAGE-A3 protein. GFP expression is normally linked on MAGE-A3 protein expression.

Tumour Cells Inoculation

On day 0, C57BL/6 mice were injected with TC-1 cells ($1 \times 10^6$ cells per mouse diluted in 100 μL of PBS 1× via the subcutaneous route in the right flank. In some experiments mice were injected at day 65 with LL2-GFP or LL2-HPV18 E7-GFP cells diluted in 100 μL of PBS 1× via the subcutaneous route in the left flank.

Vaccine

Construction and purification of recombinant CyaA-HPV16 E7$_{\Delta 30-42}$ (C16-1) and CyaA-HPV18 E7$_{\Delta 32-42}$ (C18-1).

Figure 1:
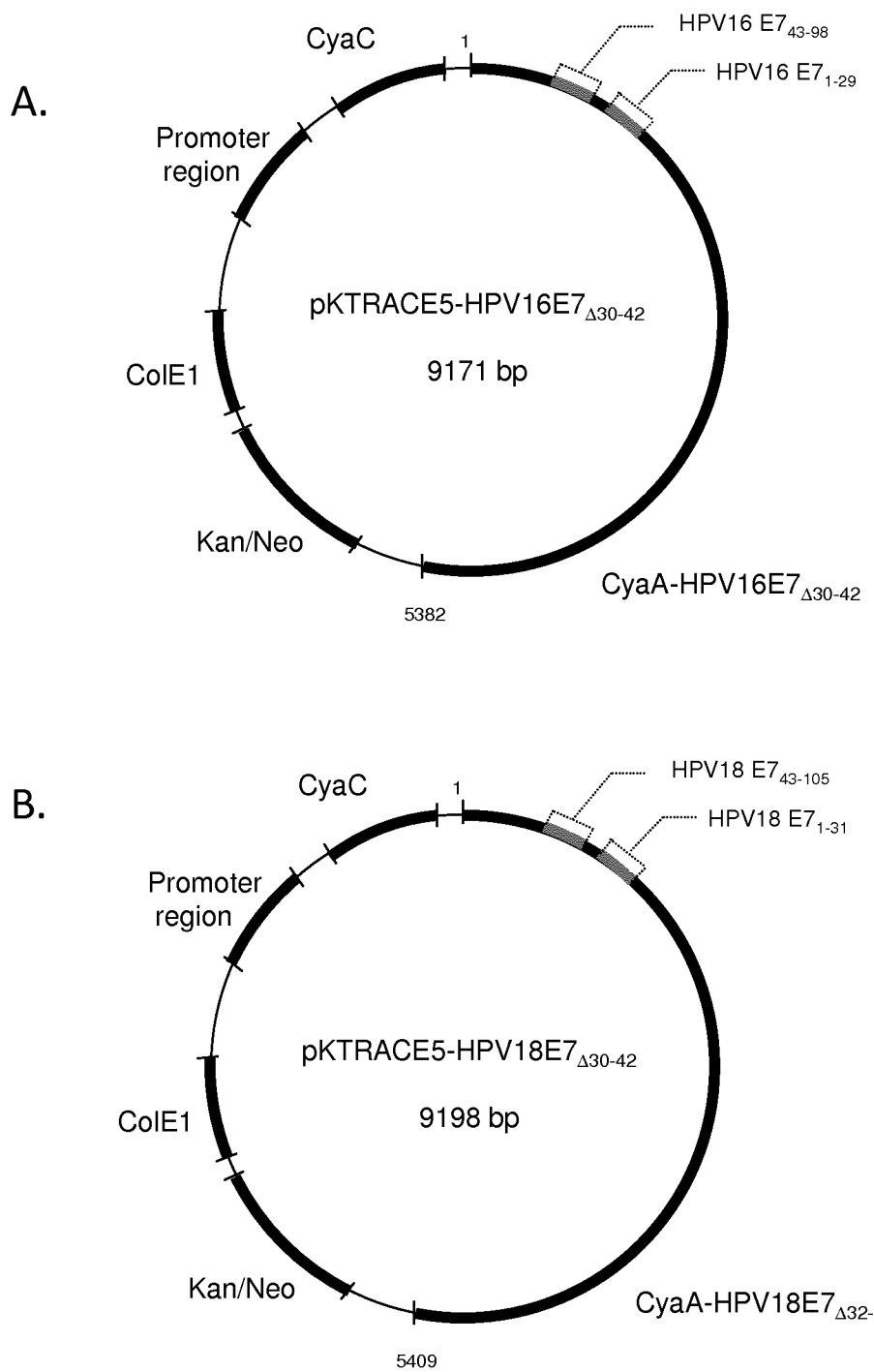
FIG. 1: (A) Schematic map of pKTRACE5-HPV16E7$_{\Delta30\text{-}42}$ in which relevant restriction sites and inserted sequences are indicated for CyaA-HPV16E7$_{\Delta30\text{-}42}$; (B) Schematic map of pKTRACE5-HPV18E7$_{\Delta32\text{-}42}$ in which relevant restriction sites and inserted sequences are indicated for CyaA-HPV18E7$_{\Delta32\text{-}42}$
Figure 2:
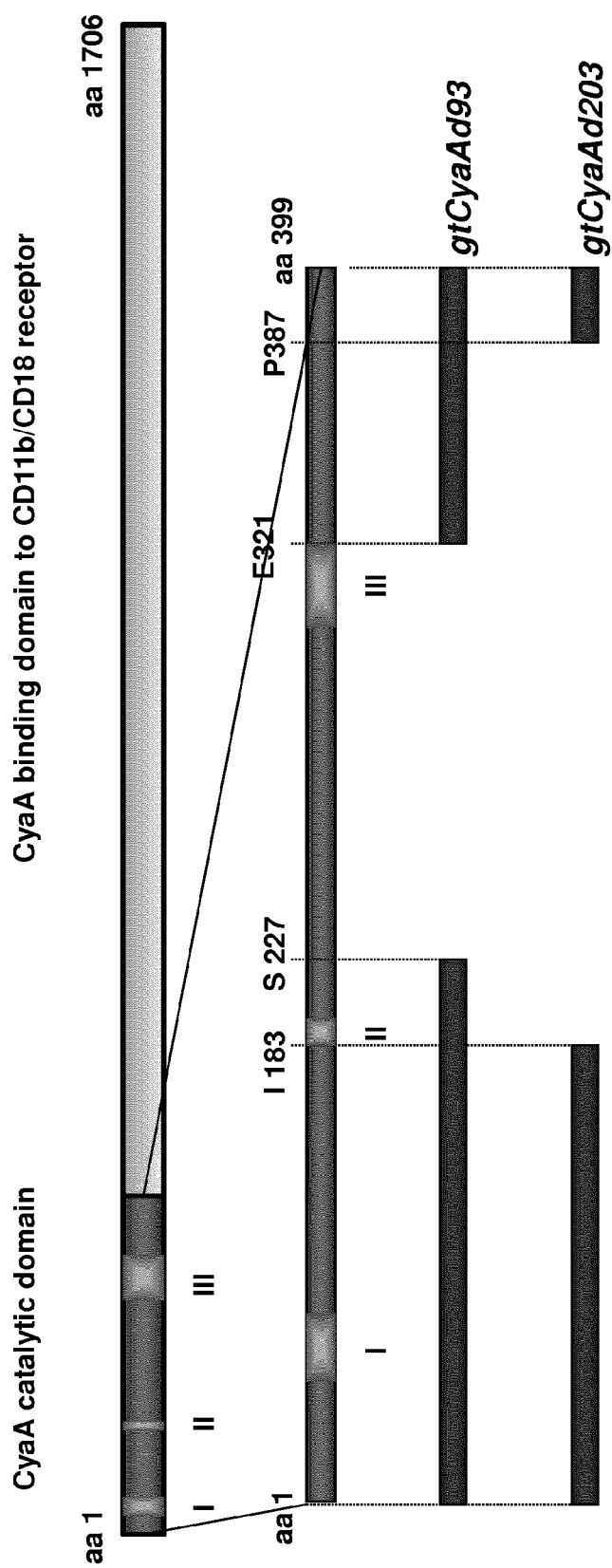
FIG. 2: the gtCyaA protein and designed gtCyaA mutants. From aa (residues) 1 to 400, the catalytic domain (AC); from aa 401 to 1706, the haemolytic domain. Within the catalytic domain, three clear boxes represent the three regions described as essential for CyaA activity ([15], [16], [1]): the domain I (aa54-77) implicated in the interaction with ATP, the domain II (aa184-198) implicated in the interaction with Mg2+-ATP and the domain III (aa 287-318) implicated in the interaction with the Calmoduline (CaM). gtCyaAd93 corresponds to the gtCyaA sequence deleted for 93 aa (228-320). gtCyaAd203 corresponds to the gtCyaA sequence deleted for 203 aa. (184-386).

Construction and purification were already described in EP1 576 967 B1. The two final bulks of CyaA-HPV16 E7$_{\Delta 30-42}$ (C16-1) (FIG. 1A) and CyaA-HPV18 E7$_{\Delta 32-42}$ (C18-1) (FIG. 1B) were mixed in Genticel at a 1:1 ratio in order to produce the bivalent composition named ProCervix which was then stored at −80° C. in aliquots.

Construction and Purification of gtCyaAd93- and gtCyaAd203-Based Vaccines:

The DNA sequence of wild type CyaA (CyaAwt: GeneBank: CAE41066.1) was optimized and synthetized (GeneCust) for the expression in *E. Coli*. The optimized DNA sequence is named gtCyaA. This sequence carries the following unique restriction sites added to facilitate the insertion of antigenic sequences into CyaA-catalytic domain:

Nde I (CATATG), BamH I (GGATCC), EcoR I (GAATTC), EcoR V (GATATC), Pci I (ACATGT), Bcl I (TGATCA), Age I ACCGGT), Xma I (CCCGGG), Nco I (CCATGG).

The gtCyaA was then inserted in the pGTPc608 plasmid that contains a pTAC inducible promoter (plasmid provided by GTP Technology, Labege, France).

Two deletion mutants were tested: a deletion of 93 amino acids from position 228 to position 320 of B. pertussis CyaA and a deletion of 203 amino acids from position 184 to position 386 of B. pertussis CyaA. The first deletion of 93 residues removes the calmoduline interacting domain (domain III). The second deletion of 203 residues removes domains II and III.

The deletions of 93 and 203 aa in gtCyaA were generated while inserting the antigens.

Purification of each expressed protein has been achieved by chromatography procedures; in particular ionic exchange affinity chromatography and hydrophobic exchange chromatography techniques were performed.

Figure 3:
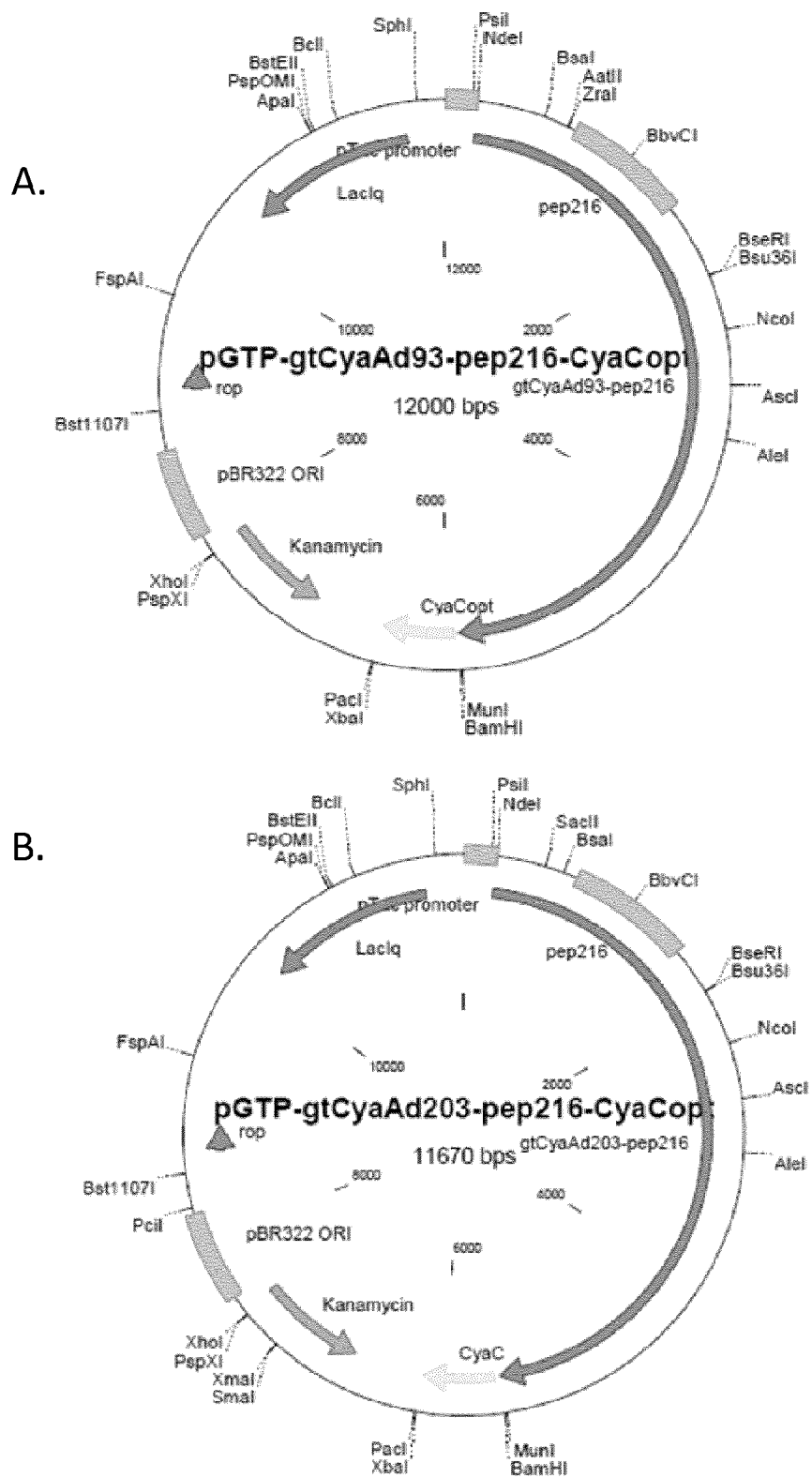
FIG. 3: (A) schematic map of the pGTPc608 vector comprising the gtCyaAd93-pep216 polynucleotide and cyaC optimized gene under the IPTG inducible promoter; (B) schematic map of the pGTPc608 vector comprising the gtCyaAd203-pep216 polynucleotide and cyaC optimized gene under the IPTG inducible promoter.

Construction and Purification of gtCyaAd93-pep216-Cya-Copt and gtCyaAd203-pep216-CyaACopt All Antigens were synthetized by DNA 2.0. (USA) or Genecust (Germany) and cloning was performed by Solvias, Switzerland. A schematic representation of gtCyaAd93-pep216-CyaACopt and gtCyaAd203-pep216-CyaAACopt is given in FIGS. 3A and 3B.

BLR bacterial strains were electroporated with each plasmid respectively. The transfected bacteria were grown in classical media and productions induced by addition of IPTG.

Purification of each expressed protein has been achieved by chromatography procedures; in particular ionic exchange affinity chromatography and hydrophobic exchange chromatography techniques were performed.

Figure 4:
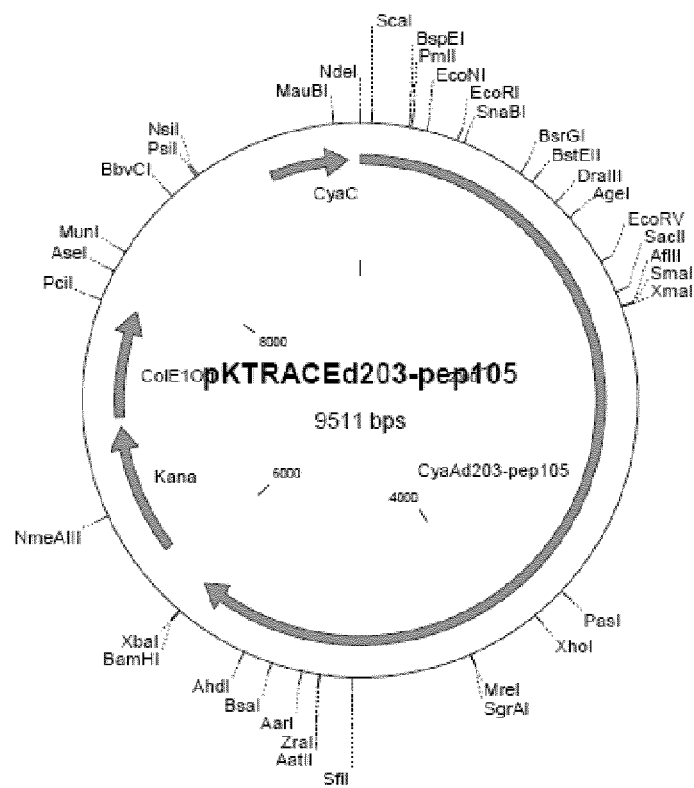
FIG. 4: CyaAd203-pep105 plasmid graphic map. Pep105 was cloned between EcoRI and XmaI restriction sites.

Construction of CyaAd203-pep105:

The CyaAd203-PEP105$_{opt}$ protein is composed by an adenylate cyclase sequence deleted of 203aa, containing, as an antigenic insert, the polypeptide 105 (PEP105). The optimized sequence of CyaA was cloned into the pKTRACE plasmid as described previously in the NdeI and BamHI restriction sites. Pep105 antigen was synthetized and cloned between EcoRI and XmaI restriction sites. Purification protocol was already described in EP1 576 967 B1. A schematic representation of pKTRACE CyaAd203-pep105$_{opt}$ is given in FIG. 4.

The polypeptide pep105 (SEQ ID NO: 24) comprises from N-terminal to C-terminal the following antigens. Some antigens have been fused whereas others are separated by linker. A particular linker (AS dipeptide) has been introduced before the GVNHQHL sequence to generate a strong murine MHC class I restricted epitope (H-$2^b$ restricted) for immune response calibration (in bold):

restriction sites: MGIR
GFP11: SRDHMVLHEYVNAAGIT
linker: GSDR
MOG$_{35-55}$: MEVGWYRSPFSRWHLYRNGK
OVA$_{257-264}$ (MHC class I-restricted peptide from the ovalbumin protein): SIINFEKL
IE$_{191-110}$: VRVDMVRHRIKEHMLKKYTQ
CLA4-TCR H-2Kd HA$_{512-520}$: IYSTVASSL
linker: SGEK
OVA$_{323-339}$ (MHC class II restricted peptide): ISQAVHAAHAEINEAGR
MELAN-A$_{26-35}$: ELAGIGILTV
HA$_{307-319}$: PKYVKQNTLKLAT
LCMV H2-Db restricted GP$_{33-41}$: KAVYNFATC
restriction sites: SG MAGEA3$_{111-180}$: RKVAELVHFLLLKYRAREPVT-KAEMLGSVVGNWQYFFPVIFSKA SSSLQLVF-GIELMEVDPIGHLYIFAT
MAGEA3$_{244-285}$: KLLTQHFVQENYLEYRQVPGSD-PACYEFLWGPRALVETSYVK
restriction sites: TG
HPV16E7 (truncated sequence): MHGDTPTL-HEYMLDLQPETTDLYCYEQLNGPA GQAEP-DRAHYNIVTFCCKCDSTLRLCVQSTHVDIRT-LEDLLMGTLGIVCPICSQKP
HPV18E7 (truncated sequence): MHGPKATLQDIVL-HLEPQNEIPVDLLCHEQLSA SGVNHQHLPAR-RAEPQRHTMLCMCCKCEARIELVVESSADDL-RAFQQLFLNTLSF VCPWCASQQ
restriction sites: LKGP Vaccine Administration On day 11, after tumour measurement, mice with detectable solid tumours were vaccinated by intradermal (id) injection into ears dermis (both ears were injected).

Adjuvant Molecules

Poly-ICLC (TLR3 agonist) was provided by Oncovir (Inc, WA, US) in vials containing 1 mL of 2 mg/mL opalescent sterile solution. The Poly-ICLC was left in the original recipient and stored at +4° C. Poly-ICLC for injection contains 2 mg/mL of poly-IC stabilized with 1.5 mg/mL poly-L-Lysine and 5 mg/mL sodium carboxymethylcellulose in 0.9% sodium chloride solution and adjusted to pH 7.6-7.8 with sodium hydroxide.

Tumour Measurement

Different parameters were taken into account to evaluate tumour development in mice:

- a Tumour size: Tumours were measured manually using a caliper twice a week starting 5 days post-tumour cells inoculation and until day 60. Tumour volume was then calculated as follow: volume=(Length×width$^2$)/2.
- Mice survival: for ethical reasons mouse developing abnormally important (limit size: 2000 mm$^3$) and/or necrotic tumours, or with tumour-induced impaired mobility were euthanized.
- Number of tumour-free mice: This information indicates when therapeutic vaccination has induced a full tumour regression (absence of palpable tumour).

Measurement of CD8 T Cell Memory Cytototoxic Responses

The method for measuring cytotoxicity of CD8$^+$ T cells in vivo has been extensively described [22, 23]. Briefly, syngeneic splenocytes from naive mice are labeled with different concentrations of CFSE (Carboxyfluorescein succinimidyl ester, Molecular Probes Invitrogen) and either pulsed in vitro with relevant peptides or let unpulsed. Both peptide-pulsed and unpulsed target cells populations were adoptively transferred intravenously into syngeneic vaccinated hosts and the loss of peptide-pulsed targets was measured by flow cytometry (BD FACSCanto II) into the spleen. The percentage of killing was estimated from the reduction in the ratio of the percentage of pulsed target cells to unpulsed cells, corrected by the initial ratio (see below). Cellular preparations were analyzed by flow cytometry before injection to monitor CFSE labelling of the different target cells and get reference values (real percentage of each cellular population) for the calculation of the in vivo killing percentage. The three target cells populations were then injected intravenously at a 1:1:1 ratio to each vaccinated mice. The percentage of in vivo killing is calculated as described elsewhere with the following formula [24]:

PERCENT KILLING=100−([(% peptide pulsed in vaccinated/% unpulsed in vaccinated)/(% peptide pulsed before injection/% unpulsed before injection))×100)

IFN-γ ELISpot (Enzyme-Linked-Immunospot) Assay

Frequencies of IFN-γ producing specific CD8$^+$ T cells were evaluated by an ex vivo restimulation of splenocytes with either H-2$^b$-restricted peptides (HPV16 E7$_{49\text{-}57}$ and HPV18 E7$_{AS43\text{-}49}$) or peptide bank of HPV45 E7 protein. This was achieved by performing an IFN-γ ELISpot assay:

ELISpot assay was performed on pooled splenocytes of mice.

Briefly, total splenocytes obtained from vaccinated mice are let unstimulated or restimulated for 20 h at 37° C., 5% $CO_2$ with 1 μg/mL of each peptide as described below:

1×10$^6$ cells/well with the HPV16 E7$_{49\text{-}57}$ peptide (H-2$^b$ restricted relevant epitope)

1×10$^6$ cells/well with OVA$_{257\text{-}264}$ (H-2$^b$ restricted irrelevant epitope).

0.25×10$^6$ cells/well with HPV18 E7$_{AS43\text{-}49}$ (H-2$^b$ restricted relevant epitope).

1×10$^6$ cells/well with the HPV45 E7 peptide bank

For the experiment with the CyaAd203-PEP105$_{opt}$, additional antigenic stimulations were used:

116-2/3 peptides bank (5 μg/ml): pool of #116-2 and #116-3 (1×10$^6$ cells per well)

171 peptides bank (3 μg/ml): pool of #171-1, #171-2 and #171-3 (1×10$^6$ cells per well)

OVA$_{323\text{-}339}$, MHC-class II restricted peptide, used at 10 μg/ml (1×10$^6$ cells per well)

LCMV GP$_{33\text{-}41}$, MHC-class I restricted peptide, used at 1 μg/ml (1×10$^6$ cells per well)

MOG$_{35\text{-}55}$, MHC-class II restricted peptide, used at 10 μg/ml (1×10$^6$ cells per well)

His-tagged MAGEA3 (TAA_002_MAGE-3) protein produced at Genticel, used at 10 μg/ml.

Splenocytes: B16-GFP cells (MAGEA3 expressing or not) were cocultured at a 19:1 ratio (950000 splenocytes: 50000 B16 cells).

IFN-γ secretion was monitored by a sandwich based ELISpot revealed by BCIP/NBT using streptavidin-AKP. Data were analyzed on a Bioreader 5000-Pro S (Biosys).

II. Results

A. Confirmation of the Capacity of New Vectors of the Invention to Induce Immune Response Against a Model Antigen In order to confirm the efficiency of the new vectors of the invention in their ability to deliver large and multi-epitopic antigens, a model antigen was designed with 441 amino acids (SEQ ID NO:24).

Mice were vaccinated with the CyaAd203-pep105$_{opt}$ protein, at day 0 and euthanatized at day 7, spleens were collected and splenocytes isolated. Using these cells, T-cell mediated responses were measured using IFN-γ and IL-2 ELISpot assays. Mice vaccinated with ProCervix were used as positive controls for induction of HPV16 E7 and HPV18 E7 specific T cell responses and as negative control for the others antigens which are only delivered by the CyaAd203-PEP105$_{opt}$. All vaccinations were adjuvanted by co-injection of Poly-ICLC.

Figure 5:
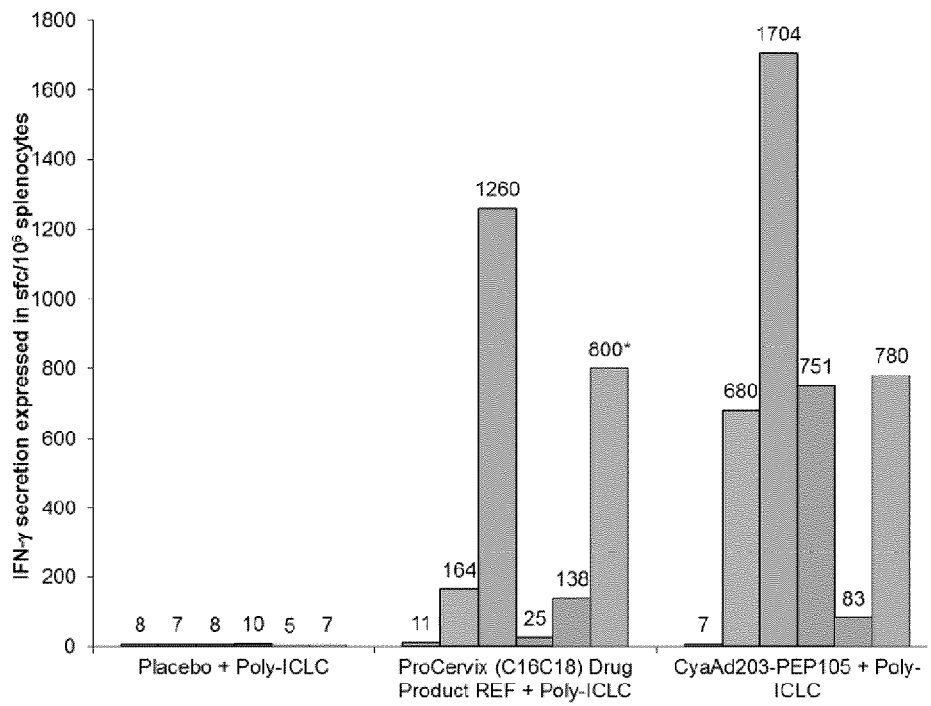
FIG. 5: Frequencies of HPV16 E7$_{49\text{-}57}$, HPV18 E7$_{\Delta S43\text{-}49}$ and OVA$_{257\text{-}264}$ and of specific CD8$^+$ T lymphocytes and frequencies of HPV16 E7 (#116-2/3) and HPV18 E7 (#171-1/2/3) specific T lymphocytes, measured seven days post-immunisation with Placebo, ProCervix or CyaAd203-PEP105. Number of events per million of total splenocytes is shown. Total splenocytes were restimulated, from left to right, with medium (control), MHC class I restricted peptides HPV16 E7$_{49\text{-}57}$, HPV18 E7$_{\Delta S43\text{-}49}$, OVA$_{257\text{-}264}$, #116-2/3 peptides banks and #171-1/2/3 peptides banks, during 20 h at 37° C., 5% $CO_2$.

A.1. Induction of HPV16 E7 HPV18 E7 and OVA$_{257\text{-}264}$ Specific IFN-γ Responses FIG. 5 illustrates the results obtained after HPV16 E7$_{49\text{-}57}$, HPV18 E7$_{AS43\text{-}49}$ and OVA$_{257\text{-}264}$ class I restricted peptides and HPV16 E7 (#116-2/3) and HPV18 E7 (#171-1/2/3) 15-mers peptides banks restimulation. The following conclusions can be drawn:

No antigen-specific immune responses were detected in the group of mice vaccinated by Poly-ICLC adjuvanted-Placebo.

Regarding the group of mice vaccinated with Poly-ICLC-adjuvanted ProCervix vaccination, whatever the restimulation, expected results were obtained:

in vitro restimulation with HPV16E7$_{49\text{-}57}$ and HPV18E7$_{AS43\text{-}49}$ class I restricted peptides induced clear HPV16 E7 and HPV18 E7-specific IFN-γ responses;

there was no specific response obtained with the OVA$_{257\text{-}264}$ restimulation;

intensity of HPV16 E7 and HPV18 E7-specific IFN-γ responses obtained with peptides banks (#116-2/3 and #171-1/2/3) were close to the level of responses obtained with MHC class I restricted peptides (HPV16E7$_{49\text{-}57}$, HPV18 E7$_{AS43\text{-}49}$).

Regarding mice vaccinated with Poly-ICLC-adjuvanted CyaAd203-PEP105opt, detection of HPV16 E7 and HPV18 E7-specific IFN-γ responses with both HPV16 E7 and HPV18 E7 peptides banks (#116-2/3 and #171-1/2/3) and all the MHC class I restricted peptides tested for ProCervix: HPV16E7$_{49\text{-}57}$, HPV18E7$_{AS43\text{-}49}$ and also with the OVA$_{257\text{-}264}$ peptide.

These results showed that the ex vivo re-stimulation with all these different peptides were able to re-stimulate HPV18 E7, HPV16 E7 and OVA$_{257\text{-}264}$ antigen-specific T-cells elicited by CyaAd203-PEP105$_{opt}$ intradermal vaccination.

A.2. Induction of T-Cell Mediated IFN-γ Responses Specific for Antigens OVA$_{323\text{-}339}$ LCMV GP$_{33\text{-}41}$, MOG$_{35\text{-}55}$ and MAGEA3

Figure 6:
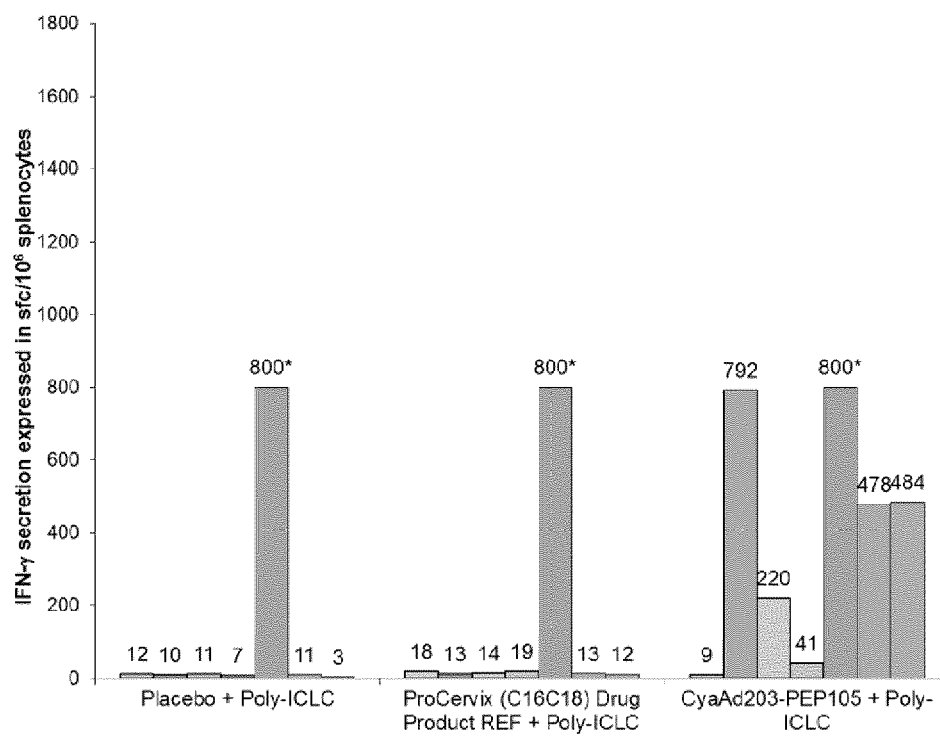
FIG. 6: Frequencies of LCMV GP$_{33\text{-}41}$, OVA$_{323\text{-}339}$, MOG$_{35\text{-}55}$ and MAGEA3 specific T lymphocytes in measured seven days post-immunisation with Placebo, ProCervix or CyaAd203-PEP105; Number of events per million of total splenocytes is shown. Total splenocytes were, from left to right, restimulated with medium (control), LCMV GP$_{33\text{-}41}$, OVA$_{323\text{-}339}$, MOG$_{35\text{-}55}$ peptides, Histag MAGE-A3 protein, or restimulated in the presence of B16 tumour cells line B16-GFP and then B16-MAGEA3-GFP used as APC, all the restimulations during 20 h at 37° C., 5% $CO_2$.

FIG. 6 depicts results obtained after different types of ex vivo restimulation:

OVA$_{323\text{-}339}$, MHC-class II restricted peptide

LCMV GP$_{33\text{-}41}$, MHC-class I restricted peptide

MOG$_{35\text{-}55}$, MHC-class II restricted peptide

His-tagged MAGEA3 protein.

B16-MAGEA3-GFP tumour cells were used as APC to stimulate antigen-specific CD8$^+$ T cells via presentation of MHC class I restricted epitopes resulting from the endogenous processing of the MAGE-A3 protein. The B16-GFP cells which are not expressing the MAGE-A3 protein were tested too as a negative control for MAGEA3 immune response specificity.

We can observe that for all group, the protein His-tag MAGE-3 induced the same unspecific response.

For mice vaccinated with Poly-ICLC-adjuvanted Placebo or Poly-ICLC-adjuvanted ProCervix, no immune responses to these antigens were detected.

For mice vaccinated with Poly-ICLC-adjuvanted CyaAd203-PEP105opt, antigen-specific IFN-γ secreting T cells were detected after OVA$_{323\text{-}339}$, GP$_{33\text{-}41}$ and MOG$_{35\text{-}55}$ peptides restimulation, but also after B16-GFP and B16-MAGEA3-GFP cells restimulation.

These results showed that CyaAd203-PEP105$_{opt}$ vaccination has elicited I-A$^b$-restricted OVA$_{323\text{-}339}$, H-2D$^b$-restricted LCMV GP$_{33\text{-}41}$ and MOG$_{35\text{-}55}$ and GFP11 antigen-specific T-cells.

Taken together, these results highlight the exquisite efficiency of CyaA-based vaccine vectors to mount both strong Ag-specific CD4$^+$ T cells and CD8$^+$ T cells in a multi-epitopic fashion.

Unfortunately, MAGEA3-specific responses could not be measured correctly as similar frequencies of IFN-γ secreting T cells were obtained after ex vivo restimulation with both cell lines: B16-GFP or B16-MAGEA3-GFP. As the CyaAd203-PEP105$_{opt}$ embeds the GFP11 antigen, immunisation with this vaccine vector has induced GFP-specific T-cell responses which masked the MAGEA3-specific T cell response.

This study highlights for the first time the ability of a 203 residue-deleted CyaA vaccine vector to induce, in the same vaccinated mouse, antigen-specific T cell responses against several unrelated T-cell epitopes. Besides, these results also showed the exquisite ability of this 203 residue-deleted CyaA vaccine vector to induce both CD4$^+$ and CD8$^+$ T cell responses (specific responses detected against both MHC I and MHC II restricted peptides)

B. Design of HPV Antigens

Seven E7 sequences from the 7 highest risk HPV types (16, 18, 45, 31, 33, 52 and 58) have been selected based on their prevalence in women with Invasive Cell Carcinoma (ICC) and in women infected by HPV but with normal cytology [9], [10]: HPV16 E7 variant (gi_30172006; SEQ ID NO:25), HPV18 E7 variant (gi_167996747; SEQ ID NO:26), HPV31 E7 variant (gi_148727610; SEQ ID NO:27), HPV33 E7 variant (gi_257472286; SEQ ID NO:28), HPV45 E7 variant (gi_549287; SEQ ID NO:29), HPV52 E7 variant (gi_237861305; SEQ ID NO:30) and HPV58 variant (gi_19111001; SEQ ID NO:32).

E7 is composed of two functional domains separated by an acidic region. These domains have been extensively described [11-13]. The N-terminal part of the protein contains the pRB binding motif (LXCXE) and the C-terminal part of the protein contains the Zinc-finger loop. The alignment of the E7 proteins of HPV16, 18 and 45 is provided in FIG. 7A, and the alignment of the E7 proteins of HPV 31, 33, 52 and 58 is provided in FIG. 7B.

Two recombinant antigens were composed by fusion in each of three E7 sequences of respectively HPV16, 18 and 45 (with or without the acidic regions). In addition, two recombinant antigens were composed by fusion of four E7 sequences of respectively HPV 31, 33, 52 and 58 (with or without the acidic regions). The presence or not of the acidic region of each E7 follows the rational exposed in WO 2005089792, that follows the rules dictated by the literature. Indeed, acidic sequences in CyaA have been described as deleterious for the normal translocation of the catalytic domain of CyaA into the cytosol [8]. Thus here sequences with and without this region allowed to test the capacity of the new vectors of the invention (gtCyaAd93 and gtCyaAd203) to deliver these antigens to the cytosol of APCs.

The antigens composed of HPV16, 18 and 45 E7 sequences have been designed to generate candidate trivalent CyaA-vectored vaccines. These sequences have either been deleted for the acidic region or not deleted (full length) and the E7 sequences have been split up and inverted so as to obtain the arrangement represented in FIG. 8A. The sequences of the two trivalent candidate antigens have been further modified to introduce a strong T-cell murine epitope described in WO 2005089792. This epitope is generated by insertion of a dipeptide Alanine-Serine (AS) at the beginning of the sequence GVNHQHL of HPV18 E7, which is in the C-terminal part of the protein, flanking the acidic region.

The antigens composed of HPV31, 33, 52 and 58 E7 sequences have been designed to generate candidate tetravalent CyaA-vectored vaccines. As for the trivalent antigens, these sequences have been deleted of the acidic region or not deleted, and the E7 sequences have been split up and inverted so as to obtain the arrangement represented in FIG. 8B.

For each candidate, a search for the presence of epitope(s) which may induce a response against human proteins was performed. Surprisingly, the wild type sequence of HPV52 E7 contains naturally a sequence which could be an autoimmune epitope, a B*2705 epitope (9-mer, MHC I). The sequence of this epitope is 100% identical to a sequence of the human ITPR3 (Inositol 1,4,5-tri-phosphate receptor, type 3). To avoid this epitope, the sequence of HPV52 E7 has been modified based on the sequence homology with the E7 proteins of HPV31, 33 and 58 types, to replace a methionine by a leucine at position 84 and a leucine by a methionine at position 86 of SEQ ID NO: 30 (the modified sequence is LRTLQQLLM). The sequence of the modified full length E7 protein of HPV52 is as set forth in SEQ ID NO:31. Thus, the novelty of the sequences of the tetravalent antigens is derived from the arrangement of the C- and N-terminal of the E7 proteins, and the presence of the two modifications carried out in the HPV 52 E7 sequence.

The electrostatic charge of these particular antigens has been calculated as explained above. These antigens have an acidic charge inferior to −6 and carry respectively 21 cysteines in the trivalent antigens and 28 cysteines in the tetravalent antigens. The features of these antigens are summarized in table 2.

TABLE 2 features of various HPV antigens

| Name and SEQ ID | HPV valences | Size (residues) | Electrostatic charge |
|---|---|---|---|
| Pep216 (SEQ ID NO: 34) | HPV16, 18 and 45 E7 proteins (trivalent), deleted for their acidic domain | 276 | −16 |
| Pep217 (SEQ ID NO: 36) | full length HPV16, 18 and 45 E7 proteins (trivalent) | 311 | −37 |
| Pep233 (SEQ ID NO: 38) | HPV31, 33, 52 and 58 E7 proteins, (tetravalent), deleted for their acidic domain | 337 | −13 |
| Pep234 (SEQ ID NO: 40) | full length HPV31, 33, 52 and 58 E7 proteins (tetravalent), | 392 | −38 |

C. Large Deletions within the Catalytic Domain of CyaA Allow Insertion of Large and Complex Antigens The DNA of the trivalent Pep216 and Pep217 antigens and of the tetravalent Pep233 and Pep234 antigens has been synthetized and cloned into the new gtCyaAd93 and gtCyaAd203 vectors. As controls, each E7 protein was inserted individually in gtCyaAd93, to see whether the E7 sequence of HPV31, 33, 45, 52 and 58 was problematic as they were never inserted in a CyaA protein before.

TABLE 3 features of chimeric proteins of the invention (the sequence of BTpr_114 is as set forth in SEQ ID NO: 58; the sequence of BTpr_116 is as set forth in SEQ ID NO: 61; the sequence of BTpr_115 is as set forth in SEQ ID NO: 64; the sequence of BTpr_117 is as set forth in SEQ ID NO: 67); the sequence of the E7 insert of BTpr_131 is as set forth in SEQ ID NO: 70; the sequence of the E7 insert of BTpr_132 is as set forth in SEQ ID NO: 71; the sequence of the E7 insert of BTpr_133 is as set forth in SEQ ID NO: 73; the sequence of the E7 insert of BTpr_134 is as set forth in SEQ ID NO: 74; the sequence of the E7 insert of BTpr_120 is as set forth in SEQ ID NO: 72.

| Valence of candidates | Protein code | gtCyaA deletion (vector) | Antigens specificity |
|---|---|---|---|
| Trivalent | BTpr_114 | 93 | HPV16, 18, 45 E7 proteins, deleted for their acidic domain |
|  | BTpr_116 | 203 | HPV16, 18, 45 E7 proteins, deleted for their acidic domain |
|  | BTpr_115 | 93 | full length HPV16, 18, 45 E7 proteins |
|  | BTpr_117 | 203 | full length HPV16, 18, 45 E7 proteins |
| Tetravalent | BTpr_143 | 93 | HPV31, 33, 52 and 58 E7 proteins, deleted for their acidic domain |
|  | BTpr_144 | 203 | HPV31, 33, 52 and 58 E7 proteins, deleted for their acidic domain |
|  | BTpr_145 | 93 | full length HPV31, 33, 52 and 58 E7 proteins |
|  | BTpr_146 | 203 | full length HPV31, 33, 52 and 58 E7 proteins |
| Monovalent | BTpr_131 | 93 | HPV31 E7, deleted for its acidic region |
|  | BTpr_132 | 93 | HPV33 E7, deleted for its acidic region |
|  | BTpr_133 | 93 | HPV52 E7, deleted for its acidic region |
|  | BTpr_134 | 93 | HPV58 E7, deleted for its acidic region |
|  | BTpr_120 | 93 | HPV45 E7, deleted for its acidic region |

The production and analytical characteristics of these monovalent, trivalent and tetravalent antigens have been evaluated.

Figure 9:
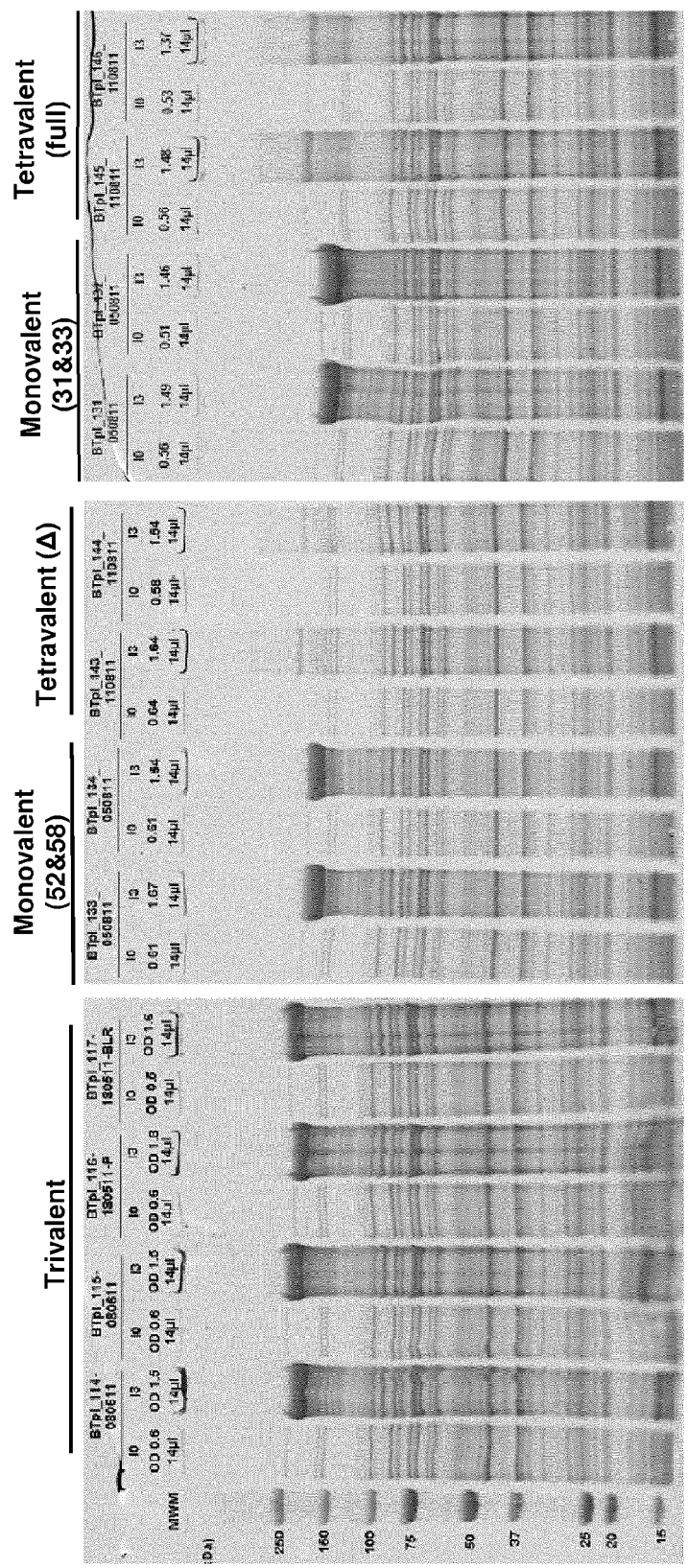
FIG. 9: protein expression profile after 3 h induction with IPTG (10: before induction; 13: after induction)

Thus, Pre-Master Cell Banks (pre-MCB) were performed for each construction and tested for induction of the proteins of interest with IPTG (FIG. 9). Monovalent and trivalent candidates had a normal profile after induction on SDS-page gel analysis while tetravalent candidates show a weak band at the expected size.

This profile was confirmed for each molecule fermented in 5 liter fermentor. Characteristics of produced chimeric proteins are summarized in Table 4.

TABLE 4 production and analytical characteristics of monovalent, trivalent and tetravalent chimeric proteins

| Protein code | Purity % | LPS content EU/mg | HCP content % | Enzymatic activity (cAMP test) |
|---|---|---|---|---|
| BTpr_114 | 93 | <100 | <2 | No enzymatic activity detected |
| BTpr_116 | 91 | <100 | <2 | No enzymatic activity detected |
| BTpr_115 | 93 | >100 and <500 | <2 | No enzymatic activity detected |
| BTpr_117 | 90 | <100 | <2 | No enzymatic activity detected |
| BTpr_143 | 11 | <100 | <2 | No enzymatic activity detected |
| BTpr_144 | 11 | <100 | <2 | No enzymatic activity detected |
| BTpr_131 | 96 | <100 | <2 | No enzymatic activity detected |
| BTpr_132 | 96 | <100 | <2 | No enzymatic activity detected |
| BTpr_133 | 96 | <100 | <2 | No enzymatic activity detected |
| Btpr_134 | 96 | <100 | <2 | No enzymatic activity detected |
| Btpr_120 | 97 | <100 | <2 | No enzymatic activity detected |

From a production point of view, whatever the deletion, the recombinant gtCyaAs with the monovalent and trivalent antigens give acceptable yield and purity (>90%), while the tetravalent candidates have a reduced purity (11% of protein of interest).

Considering overall purity when comparing candidates bearing the deletion of 93 residues versus candidates deleted of 203 residues, it appears that the latter have a yield inferior to the gtCyaAd93 (Btpr114 & Btpr_115) constructs. This difference is quite surprising as one would expect the shorter recombinant gtCyaA to be easier to produce.

Both vectors with their antigens have no enzymatic activity highlighting that the deletion is sufficient to detoxify the vectors.

D. Production of GtCyaAs with at Least 4 E7 is Sequence Dependent

We further investigated whether the results obtained with the tetravalent candidates were due to the number of E7 polypeptide sequences in CyaA or to a particular assembly of E7 polypeptide sequences in CyaA. For that purpose, various constructs were tested (Table 5).

TABLE 5 chimeric proteins with trivalent and tetravalent HPV antigens

| Protein code | gtCyaA deletion | HPV types in the insert | Insert size |
|---|---|---|---|
| Btpr_161 | 93 | 31, 52, 58 E7 proteins, deleted for their acidic region | 253 aa |
| Btpr_162 | 93 | 31, 33, 52 E7 proteins, deleted for their acidic region | 253 aa |
| Btpr_163 | 93 | 16, 18, 45, 33 E7 proteins, deleted for their acidic region | 360 aa |
| Btpr_164 | 93 | 16, 18, 45, 58 E7 proteins, deleted for their acidic region | 360 aa |
| Btpr_165 | 93 | full length 31, 52, 58 E7 proteins | 295 aa |
| Btpr_166 | 93 | full length 31, 33, 52 E7 proteins | 294 aa |
| Btpr_167 | 93 | full length 16, 18, 45, 33 E7 proteins | 408 aa |
| Btpr_168 | 93 | full length 16, 18, 45, 58 E7 proteins | 409 aa |
| Btpr_169 | 203 | 31, 52, 58 E7 proteins, deleted for their acidic region | 253 aa |
| Btpr_170 | 203 | 31, 33, 52 E7 proteins, deleted for their acidic region | 253 aa |
| Btpr_171 | 203 | 16, 18, 45, 33 E7 proteins, deleted for their acidic region | 360 aa |
| Btpr_172 | 203 | 16, 18, 45, 58 E7 proteins, deleted for their acidic region | 360 aa |
| Btpr_173 | 203 | full length 31, 52, 58 E7 proteins | 295 aa |
| Btpr_174 | 203 | full length 31, 33, 52 E7 proteins | 294 aa |
| Btpr_175 | 203 | full length 16, 18, 45, 33 E7 proteins | 408 aa |
| Btpr_176 | 203 | full length 16, 18, 45, 58 E7 proteins | 409 aa |

Pre-MCB induction tests were performed and surprisingly the number of E7 sequences in CyaA was not the limit. It was rather the overall sequence nature of the antigen. Moreover, Btpr_161, 162, 169 and 170 showed lower yields of protein of interest when compared to the full length antigens (BTpr_165, 166, 173 and 174) (Table 6).

TABLE 6

Summary of pre-MCB induction results

| Protein code | HPV types in the insert | gtCyaA deletion | Inductibility results |
|---|---|---|---|
| Btpr_161 | 31, 52, 58 E7 proteins, deleted for their acidic region | 93 | Weaker protein expression than Btpr_165 |
| Btpr_162 | 31, 33, 52 E7 proteins, deleted for their acidic region | 93 | Weaker protein expression than BTpr_166 |
| Btpr_163 | 16, 18, 45, 33 E7 proteins, deleted for their acidic region | 93 | significantly better profile expression than BTpr_143 |
| Btpr_164 | 16, 18, 45, 58 E7 proteins, deleted for their acidic region | 93 | significantly better profile expression than BTpr_143 |
| Btpr_165 | full length 31, 52, 58 E7 proteins | 93 | Protein expression profile similar BTpr_114 |
| Btpr_166 | full length 31, 33, 52 E7 proteins | 93 | Protein expression profile similar BTpr_114 |
| Btpr_167 | full length 16, 18, 45, 33 E7 proteins | 93 | / |
| Btpr_168 | full length 16, 18, 45, 58 E7 proteins | 93 | / |
| Btpr_169 | 31, 52, 58 E7 proteins, deleted for their acidic region | 203 | Weaker protein expression than Btpr_173 |
| Btpr_170 | 31, 33, 52 E7 proteins, deleted for their acidic region | 203 | Weaker protein expression than Btpr_174 |
| Btpr_171 | 16, 18, 45, 33 E7 proteins, deleted of the acidic region | 203 | / |
| Btpr_172 | 16, 18, 45, 58 E7 proteins, deleted for their acidic region | 203 | / |
| Btpr_173 | full length 31, 52, 58 E7 proteins | 203 | Protein expression profile similar BTpr_114 |
| Btpr_174 | full length 31, 33, 52 E7 proteins | 203 | Protein expression profile similar BTpr_114 |
| Btpr_175 | full length 16, 18, 45, 33 E7 proteins | 203 | / |
| Btpr_176 | full length 16, 18, 45, 58 E7 proteins | 203 | / |

From the experiments above, we can conclude that gtCyaAd93 and gtCyaAd203 accept the equivalent polypeptide sequence corresponding to at least 4 E7 proteins. However, the sequence and arrangement of chosen E7 fragments may have an impact on yield and purity and thus have more or less favourable industrialization potential.
Confirmation of Results Observed with the Pre-MCB The inventors further investigated if the results obtained at the pre-MCB level were confirmed with a particular focus on tetravalent constructs in the gtCyaAd93 vector. Proteins that had a better expression profile than BTpr_143 or equivalent to BTpr_115 were tested at 5 L scale. The following table summarizes the results obtained.

TABLE 7

Summary of pre-MCB induction and 5 L production results

| Protein code | HPV types in the insert | gtCyaA deletion | Inductibility results (pre-MCB) | 5 liters scale results |
|---|---|---|---|---|
| Btpr_163 | 16, 18, 45, 33 E7 proteins deleted of the acidic region | 93 | significantly better profile expression than BTpr_143 | Productivity at least 3 times superior and purity at least 6 times superior to BTpr_143 |
| Btpr_164 | 16, 18, 45, 58 E7 proteins deleted of the acidic region | 93 | significantly better profile expression than BTpr_143 | Productivity at least 4 times superior and purity at least 6 times superior to BTpr_143 |
| Btpr_165 | 31, 52, 58 E7 proteins full length | 93 | Protein expression profile similar BTpr_115 | Productivity at least 1.5 time superior to BTpr_115 and purity equivalent |
| Btpr_166 | 31, 33, 52 E7 proteins full length | 93 | Protein expression profile similar BTpr_115 | Productivity at least 1.5 times superior to BTpr_115 and purity equivalent |
| Btpr_167 | 16, 18, 45, 33 E7 proteins full length | 93 | Better profile expression than BTpr_143 | Productivity at least 2 times superior to BTpr_143 and purity at least 5 times superior |
| Btpr_168 | 16, 18, 45, 58 E7 proteins full length | 93 | Better profile expression than BTpr_143 | Productivity at least 3 times superior to BTpr_143 and purity at least 5 times superior |
| Btpr_173 | 31, 52, 58 E7 | 203 | Protein expression | Productivity at least 2 times |

TABLE 7-continued

Summary of pre-MCB induction and 5 L production results

| rotein code | HPV types in the insert | gtCyaA deletion | Inductibility results (pre-MCB) | 5 liters scale results |
|---|---|---|---|---|
| Btpr_175 | proteins full length region 16, 18, 45, 33 E7 proteins full length | 203 | profile similar BTpr_117 Better protein expression profile than Btpr_143 | superior to BTpr_117 and purity equivalent. Productivity inferior to BTpr_143 despite a significant better purity (at least 6 times) |

From the experiment above, it has been concluded that:
1. Overall productivity and purity has been improved for all the tested constructs except for Btpr_175.
2. Productivity and expression profiles are always inferior in recombinant proteins with gtCyaAd203 than with gtCyaAd93.
3. The gtCyaAd93 vector allows the production of recombinant proteins containing 4 HPV antigens with a better yield and purity than the gtCyaAd203 vector.
4. These results confirm the observations made on the pre-MCB.

E. gtCyaAd93 and gtCyaAd203 Containing Large Antigens are Immunogenic

E.1 Immunogenicity of BTpr_114, BTpr_115, BTpr_116 and BTpr_117

The immunogenicity of the BTpr_114, BTpr_115, BTpr_116 and BTpr_117 chimeric proteins, was further investigated. Mice were vaccinated intradermally either with the placebo or with ProCervix (positive control composed of CyaA-HPV16 E7+CyaA-HPV18 E7) or with Btpr_114 (gtCyaAd93-PEP216-CyaCopt), BTpr_115 (gtCyaAd93-pep217-CyaCopt), BTpr_116 (gtCyaAd203-pep216-CyaCopt) and BTpr_117 (gtCyaAd203-pep217-CyaCopt) respectively. All groups were adjuvanted with poly IC-LC. 7 days after vaccination mice were euthanized and splenocytes were restimulated with previously identified MHC class I restricted peptides. Results were presented in FIG. 10.

Figure 10:
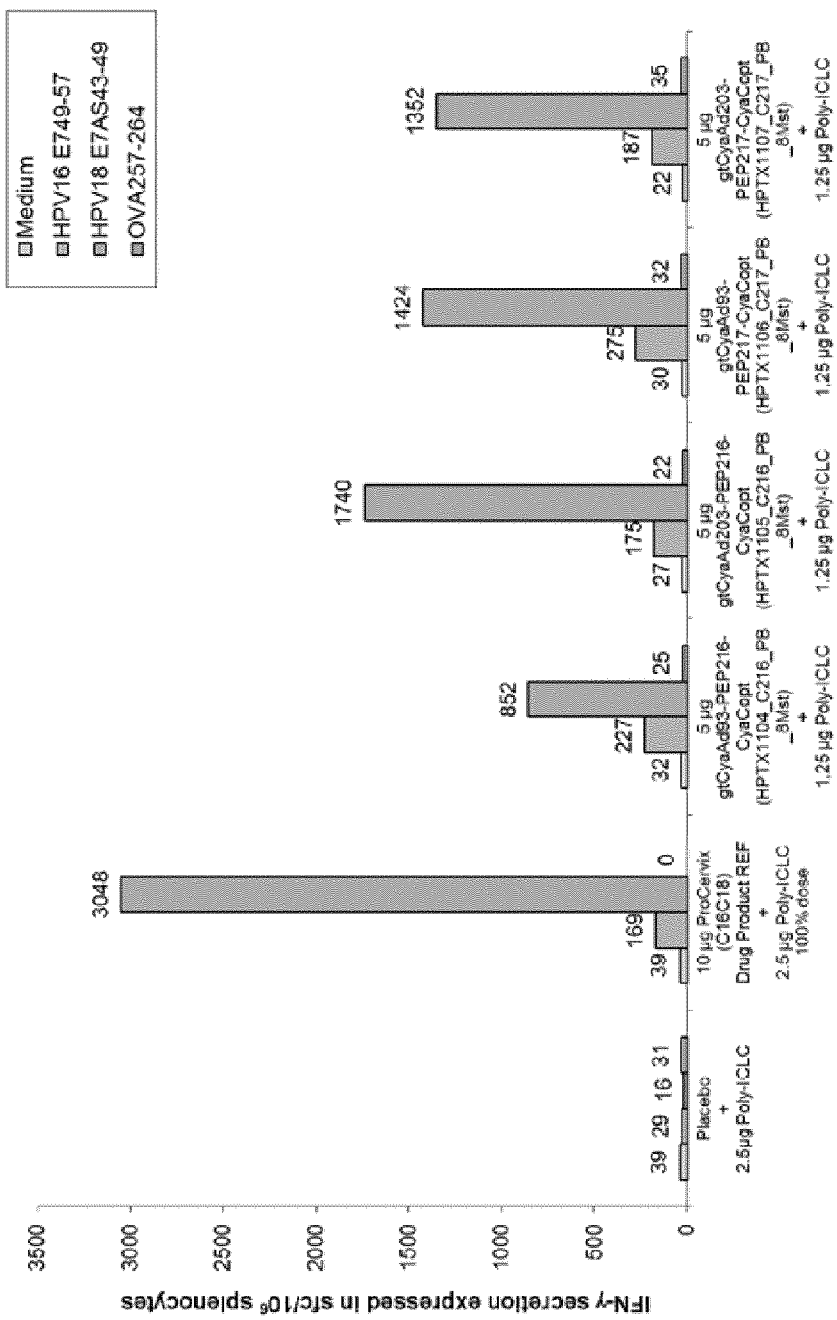
FIG. 10: Frequencies of HPV16 E7$_{49\text{-}57}$ and HPV18 E7$_{\Delta S43\text{-}49}$ specific CD8$^+$ T lymphocytes measured seven days post-immunisation; Total splenocytes were restimulated with MHC class I-restricted peptides. Results are expressed as number of cells that secreted IFN-γ per million of total splenocytes.

FIG. 10 showed that:
the immunisation with 10 µg of ProCervix induced an expected level of HPV16 E7$_{49-57}$ and HPV18 E7$_{AS43-49}$-specific IFN-γ response.
antigen-specific responses obtained with trivalent candidates vaccines were equivalent to the one obtained with ProCervix.
no differences were observed between trivalent candidates, in the frequency of specific T cells responses.
the lower response against the HPV16 antigen is due to the fact that the HPV16 epitope is a weaker than the HPV 18 epitope to which C56LB/6 mice are very sensitive.

These observations enabled to conclude that poly-ICLC-adjuvanted gtCyaAd93-PEP216-CyaCopt, gtCyaAd203-PEP216-CyaCopt, gtCyaAd93-PEP217-CyaCopt and gtCyaAd203-PEP217-CyaCopt are as efficient as poly-ICLC-adjuvanted ProCervix in the induction of HPV16 E749-57 and HPV18 E7AS43-49-specific IFN-γ responses in mice after intradermal immunization.

Since no MHC-I-restricted peptide was identified for HPV45 E7 in mice at the time of the experiment, splenocytes were restimulated with an HPV45 E7-peptide library divided into three sub-pools (#218-1, #218-2 and #218-3). This experiment is the first restimulation, known to the inventors, made with a peptide library rather than with a peptide corresponding to a known epitope.

Figure 11:
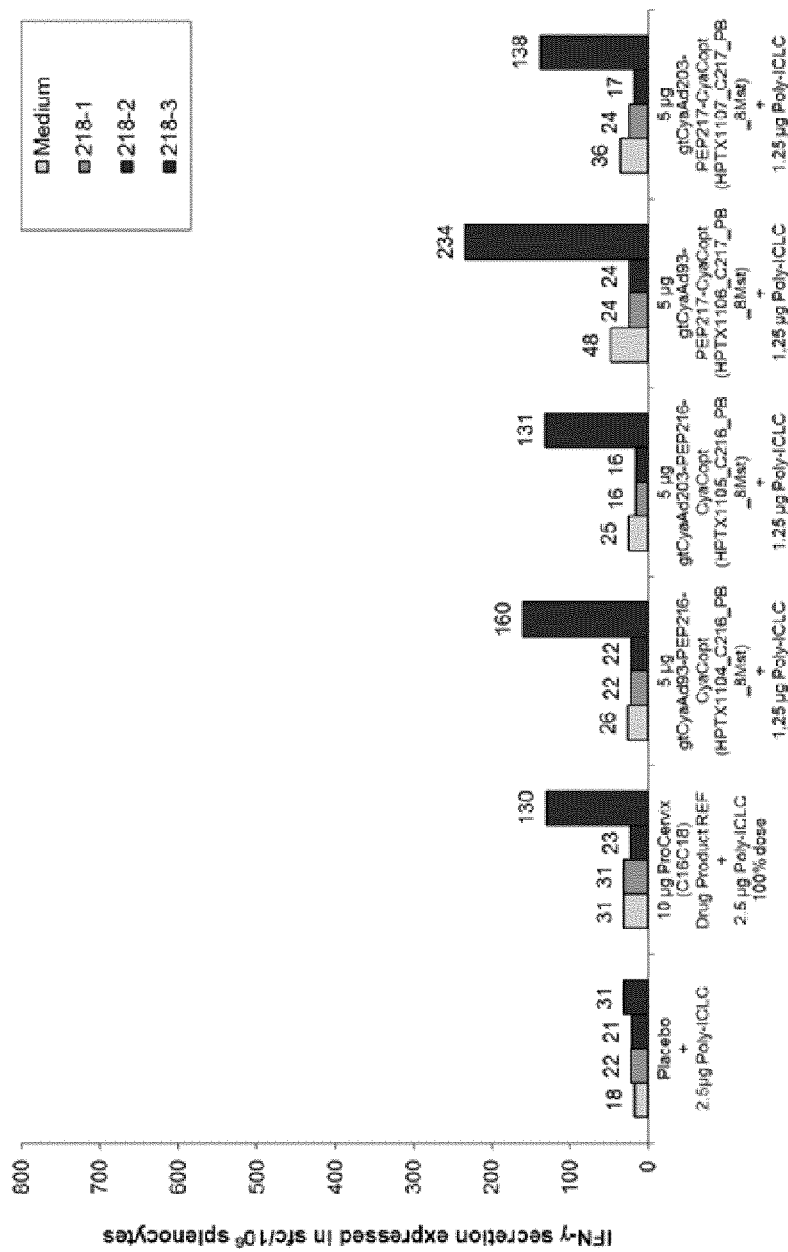
FIG. 11: Frequencies of HPV45 E7 specific IFN-γ secreting T lymphocytes measured seven days post-immunisation.

FIG. 11 showed that the in vitro restimulation with #218-3 peptide sub-pool, but not the #218-1 and #218-2 sub-pools, was able to re-stimulate T-cells elicited by gtCyaAd93-PEP216-GyaC$_{opt}$, gtCyaAd203-PEP216-GyaC$_{opt}$, gtCyaAd93-PEP217-GyaC$_{opt}$ and gtCyaAd203-PEP217-GyaC$_{opt}$ vaccination. The peptide sequence responsible for this immune response is IELTVESSAEDLRTL.

Strikingly, similar response was observed with the group vaccinated with ProCervix, which does not carry the HPV45 E7 sequence. This result can be explained by a cross reactivity between epitopes present in the #218-3 pool and the HPV16 E7 or HPV18 E7 sequences contained in the ProCervix vaccine.

Together, these results show that antigen with a complex structure (21 cysteins) and acidic charges are correctly delivered by gtCyaAd93 and gtCyaAd203 and processed by Antigen Presenting cells (APC). This is unexpected taking into consideration the results taught in Preville et al. [5], Karimova et al. [7] and Gmira et al. [8].

Moreover, the deletion performed in the catalytic domain of CyaA could provide an advantage regarding the delivered heterologous polypeptide, by decreasing the level of CyaA-specific T-cell and CyaA-specific B-cell responses (said deletion resulting in the decrease in number mainly of MHC class I and class II restricted epitopes of CyaA)

E.2 Immunogenicity of New Leads Consisting in Btpr_163, BTpr_164, BTpr_165, BTpr_166, BTpr_167, BTpr_168, BTpr_173 and BTpr_175

The immunogenicity of new leads consisting in Btpr_163, BTpr_164, BTpr_165, BTpr_166, BTpr_167, BTpr_168, BTpr_173 and BTpr_175, was further investigated in C57BL/6 mice.

Mice were vaccinated intradermally either with the placebo or with each lead, respectively. All groups were adjuvanted with poly-ICLC.

7 days after vaccination mice were euthanized and splenocytes were restimulated with peptide libraries of each E7 antigen tested. All tested leads were immunogenic. Immunogenicity against HPV31, 45 and 58 was not tested in C57BL/6 mice because the tools were not adapted (the genetic background of the mice was not suitable). Immunogenicity against these E7 proteins is tested in other strains of mice as described in the Material and Method.

TABLE 8

Immunogenicity of tested leads in C57BL/6 mice

| Protein code | HPV types in the insert | gtCyaA deletion | Immunogenicity Yes/No (IFN-γ ELISpot assay) | HPV Type with E7-specific T cell responses measured |
|---|---|---|---|---|
| Btpr_163 | 16, 18, 45, 33 E7 | 93 | Yes | 16, 18, 33 |

TABLE 8-continued

Immunogenicity of tested leads in C57BL/6 mice

| Protein code | HPV types in the insert | gtCyaA deletion | Immunogenicity Yes/No (IFN-γ ELISpot assay) | HPV Type with E7-specific T cell responses measured |
|---|---|---|---|---|
| | proteins deleted of the acidic region | | | |
| Btpr_164 | 16, 18, 45, 58 E7 proteins deleted of the acidic region | 93 | Yes | 16, 18 |
| Btpr_165 | 31, 52, 58 E7 proteins full length | 93 | Yes | 52 |
| Btpr_166 | 31, 33, 52 E7 proteins full length | 93 | Yes | 33, 52 |
| Btpr_167 | 16, 18, 45, 33 E7 proteins full length | 93 | Yes | 16, 18, 33 |
| Btpr_168 | 16, 18, 45, 58 E7 proteins full length | 93 | Yes | 16, 18 |
| Btpr_173 | 31, 52, 58 E7 proteins full length region | 203 | Yes | 52 |
| Btpr_175 | 16, 18, 45, 33 E7 proteins full length | 203 | Yes | 16, 18, 33 |

These results showed that:

The immunisation with 10 µg of each lead induced a specific IFN-γ response.

gtCyaAd93 and gtCyaAd203 delivered correctly the antigens to the antigen presenting cells.

Specific immune responses against HPV16, 18, 33 and 52 E7 proteins were measured.

These results allowed further investigation of the immune response against hexavalent and heptavalent mixes.

E.3: Immunogenicity of an Hexavalent Candidate Vaccine.

The immune response of an hexavalent mix of two trivalent leads, was evaluated in C57BL/6 mice. These leads were BTpr_114 and BTpr_165 containing respectively HPV 16-18-45, E7 proteins and HPV 31-52-58 E7 proteins. The same protocol was used as previously described. As there is no known MHCI restricted peptide identified for HPV52 E7 in mice at the time of the experiment, splenocytes were restimulated with an HPV52 E7-peptide library divided in three sub-pools (221-1, 221-2 and 221-3). For HPV16E7 and HPV18E7 restimulations, peptide libraries were also used divided in 3 sub-pools (116-1, 116-II, 116-III and 171-I, 171-II and 171-3 respectively).

The results are shown on FIG. 15.

These results confirm that:

The immunisation with 10 µg of the hexavalent mix induced HPV16 E7, HPV18 E7 and HPV52 T cell responses as measured by IFN-□ ELISpot.

Each gtCyaAd93 with its respective antigens was able to deliver them into the antigen presenting cell (APC) and to promote antigen-specific T cell responses against measurable HPV types.

No differences were observed between trivalent components alone in the frequency of E7-specific T cells responses and the hexavalent candidate vaccine. (data not shown)

These observations allowed concluding that Poly-ICLC-adjuvanted Btpr_114 and Btpr_165 are efficient at inducing HPV16 E7, HPV18E7 and HPV52 E7-specific T cell responses in C57BL/6 mice after intradermal immunization.

E.4. Immunogenicity of Two Heptavalent Candidate Vaccines

Based on productivity and purity results, two heptavalent combinations were tested in C57BL/6 mice: Btpr_165+Btpr_163 and Btpr_166+Btpr_164. Mice were immunized intradermally with 10 µg of each heptavalent candidate vaccine, respectively.

As presented in FIG. 16, these results indicate that for:

HPV16 E7: the in vitro restimulation with #116-2j (c+d) peptides sub-pool, was able to re-stimulate T-cells elicited by vaccination with both heptavalant candidate vaccines or their components alone harbouring HPV16E7.

HPV18 E7: the in vitro restimulation with #171-I and #171-II peptides sub-pools were able to re-stimulate T-cells elicited by vaccination with both heptavalant candidate vaccines and their components alone harbouring HPV18E7.

HPV33 E7:

For the heptavalent candidate vaccine composed of Btpr_166 and Btpr_164, the in vitro restimulation with the #220-2 peptide sub-pool, was able to re-stimulate T-cells elicited by vaccination.

For the heptavalent candidate vaccine composed of Btpr_165 and Btpr_163, the in vitro restimulation with #220-1, #220-2 and #220-3 peptide sub-pools were able to re-stimulate T-cells elicited by vaccination.

HPV52 E7: the in vitro restimulation #221-2 and #221-3 peptides sub-pool were able to re-stimulate T-cells elicited by vaccination with both heptavalant candidate vaccines or their components alone that harbour HPV52 E7.

Together, these results of production and immunogenicity indicate that:

Recombinant gtCyaAd93 with 3 and 4 HPV E7 proteins can be produced and purified with a good productivity;

Recombinant gtCyaAd203 proteins can also be produced and purified but with a productivity that is inferior to gtCyaAd93 vectors containing the same antigens.

Two recombinant gtCyaAd93 with 3 and 4 HPV E7 proteins can correctly deliver their antigens to APCs.

A specific immune response is measured against each immunogenic HPV type in C57BL/6 mice The design of the E7 proteins with a recombinant gtCyaAd93 may have an impact on the immune response against E7 antigens e.g. as illustrated with HPV33 E7.

Antigens with a complex structure (21 cysteins) and acidic charges are correctly delivered by gtCyaAd93 and processed by Antigen Presenting cells (APC). This is unexpected taking into consideration results from Gmira et al. 2001, and Fayolle et al., 1998.

F. Cytotoxic Efficiency of Candidates

F.1 CD8-Mediated Cytotoxic Efficiency of Trivalent Candidate Vaccines

In order to compare the efficiency of the trivalent candidates in cytotoxicity induction, in vivo killing assays were performed with and without adjuvant. Splenocytes from naive mice were collected and loaded with peptide libraries from HPV16, HPV18 and HPV45 E7 proteins, respectively.

4 groups of mice were vaccinated with a placebo, with gtCyaAd93-pep216-CyaCopt, with gtCyaAd93-pep217-CyaCopt and with gtCyaAd203-pep217-CyaCopt in the presence or not of poly IC-LC, respectively.

In the presence of adjuvant, no difference was observed between candidates (data not shown). In the left panel of FIG. 12 (loading with libraries #171-1 and #171-2), the percentage of killing is superior in mice vaccinated with the chimeric protein containing the full length antigens (pep217) as compared to mice vaccinated with the chimeric protein containing the deleted antigen pep216. Similarly, in the right panel of FIG. 12 (loading with peptide library #218-3), the percentage of killing is superior in mice vaccinated with the chimeric protein containing pep217 while no killing is observed in mice vaccinated with the chimeric protein containing pep216 when compared to the placebo. Without poly-LCLC adjuvant, gtCyaAs harbouring full length antigens were more efficient in killing their target cells as compared to the antigens deleted for this acid domain. This is unexpected as full length antigens contain the E7 acidic domains and according to the teaching of the literature should be less efficient than antigens deleted for this acid domain.

These results indicate that
the full length antigens probably have epitopes (helper T-cell epitopes) that favour the killing response by CD8$^+$ T lymphocytes; and
the gtCyaA vectors allow the delivery of antigens with acidic regions F.2 CD8-Mediated Cytotoxic Efficiency of Heptavalent Candidate Vaccines In order to compare the efficiency of the heptavalent candidate vaccines in their ability to induce E7-specific cytotoxic T lymphocytes (CTL), in vivo killing assays were performed with adjuvant. Splenocytes from naïve mice were collected and loaded with peptide libraries from HPV16 and HPV18 E7 proteins, respectively.

3 groups of mice were vaccinated with a placebo, with BTpr165+BTpr163 and BTpr166+BTpr164 in the presence of Poly-ICLC, respectively.

No E7-specific killing was observed in the placebo group. Both heptavalent candidate vaccines induced E7-specific killing of cells loaded respectively with HPV16 E7 peptide library (FIG. 17-A) or HPV18 E7 peptide library (FIG. 17-B).

These results indicate that both heptavalent candidates induce functional HPV16 and HPV18 E7-specific CTL.

G. Tumour Regression Assays in Mice Bearing TC-1 Tumours

We further investigated the therapeutic efficiency of the four trivalent candidates Btpr_114 (gtCyaAd93-PEP216-CyaCopt), BTpr_115 (gtCyaAd93-pep217-CyaCopt), BTpr_116 (gtCyaAd203-pep216-CyaCopt) and BTpr_117 (gtCyaAd203-pep217-CyaCopt) using the TC-1 tumour cell model.

Mice were all inoculated with TC-1 cells (expressing HPV16 E7 antigen) at day 0. Group 1 was left untreated. Group 2 was treated with PBS and Poly-ICLC, group 3 was treated with ProCervix adjuvanted with Poly-ICLC, group 4 was treated with gtCyaAd93-pep216 adjuvanted with Poly-ICLC, group 5 with gtCyaAd203-pep216 adjuvanted with polyIC-LC, group 6 with gtCyaAd93-pep217 adjuvanted with Poly-ICLC and group 7 with gtCyaAd203-pep217 adjuvanted with Poly-ICLC. Each group was composed of 10 mice.

FIG. 13 shows that all mice developed tumours. However, mice vaccinated with a CyaA candidate vaccine embedding the HPV16 E7 antigen and adjuvanted with Poly-ICLC displayed a strong tumour clearance rate at day 65: 9 out of 10 mice treated with ProCervix+Poly-ICLC cleared tumours (group 3); 9 out of 10 mice treated with gtCyaAd93-pep216+Poly-ICLC regressed tumours (group 4); 8 out of 10 mice vaccinated with gtCyaAd203-pep216+Poly-ICLC regressed tumours (group 5); 9 out of 10 mice treated with gtCyaAd93-pep217+Poly-ICLC regressed tumours (group 6); 9 out of 10 mice vaccinated with gtCyaAd203-pep217+Poly-ICLC regressed tumours (group 7). 0 out of 10 and 1 out of 10 mice untreated or treated with the placebo+Poly-ICLC regressed tumours respectively (group 1 and group 2). Thus, only mice that were vaccinated with a candidate vaccine containing the HPV16 E7 antigen were able to regress tumours significantly. Between the four vaccine candidates, no difference was observed in their capacity to regress tumours.

These results show that administration of chimeric proteins of the invention, such as Btpr_114 (gtCyaAd93-PEP216-CyaCopt), BTpr_115 (gtCyaAd93-pep217-CyaCopt), BTpr_116 (gtCyaAd203-pep216-CyaCopt) and BTpr_117 (gtCyaAd203-pep217-CyaCopt) enables to efficiently regress tumours provoking oncogenic disorders.

H. Therapeutic and Prophylactic Effect of Trivalent Candidates

The capacity of vaccinated mice to be protected against the development and growth of a tumour, following eradication of a first tumour expressing a different antigen was further evaluated. LL2 tumour cells expressing HPV18 E7 antigen and the control cell line LL2-GFP were inoculated on the flank of the surviving vaccinated mice, which have previously fully regressed the TC-1 grafted tumours (expressing HPV16 E7 antigen).

Each group of surviving mice was divided in two subgroups that were inoculated either with LL2-HPV18 E7 cells or LL2-GFP cells. Results are shown in FIG. 14.

Mice vaccinated with a gtCyaA candidate vaccine embedding the HPV18 E7 antigen and adjuvanted with Poly-ICLC displayed a strong protective effect against the growth of LL2-HPV18 E7 cell line (no mice developed tumour in groups 3b, 4b, 5b, 6b and 7b) but not against the growth of LL2-GFP cell line (all mice developed tumours in groups 3a, 4a, 5a, 6a and 7a).

Together, these results highlight that mice vaccinated with the trivalent candidates, which have eliminated TC-1 tumours, were also protected against the LL2-HPV18E7 tumours and indicates that said vaccinated mice, which have developed a curative antigen-specific T cell response against HPV16 E7 antigen, have also developed a protective antigen specific T-cell response against HPV18 E7 antigen

BIBLIOGRAPHY

[1] Ladant D, Glaser P, Ullmann A. Insertional mutagenesis of *Bordetella pertussis* adenylate cyclase. J Biol Chem 1992; 267: 2244-50.

[2] Sebo P, Fayolle C, d'Andria O, Ladant D, Leclerc C, Ullmann A. Cell-invasive activity of epitope-tagged adenylate cyclase of *Bordetella pertussis* allows in vitro presentation of a foreign epitope to CD8+ cytotoxic T cells. Infect Immun 1995; 63: 3851-7.

[3] Dadaglio G, Moukrim Z, Lo-Man R, Sheshko V, Sebo P, Leclerc C. Induction of a polarized Th1 response by insertion of multiple copies of a viral T-cell epitope into adenylate cyclase of *Bordetella pertussis*. Infect Immun 2000; 68: 3867-72.

[4] Fayolle C, Ladant D, Karimova G, Ullmann A, Leclerc C. Therapy of murine tumours with recombinant *Bordetella pertussis* adenylate cyclase carrying a cytotoxic T cell epitope. J Immunol 1999; 162: 4157-62.

[5] Preville X, Ladant D, Timmerman B, Leclerc C. Eradication of established tumours by vaccination with recombinant *Bordetella pertussis* adenylate cyclase carrying the human papillomavirus 16 E7 oncoprotein. Cancer Res 2005; 65: 641-9.

[6] Berraondo P, Nouze C, Preville X, Ladant D, Leclerc C. Eradication of large tumours in mice by a tritherapy targeting the innate, adaptive, and regulatory components of the immune system. Cancer Res 2007; 67: 8847-55.

[7] Karimova G, Fayolle C, Gmira S, Ullmann A, Leclerc C, Ladant D. Charge-dependent translocation of *Bordetella pertussis* adenylate cyclase toxin into eukaryotic cells: implication for the in vivo delivery of CD8(+) T cell epitopes into antigen-presenting cells. Proc Natl Acad Sci USA 1998; 95: 12532-7.

[8] Gmira S, Karimova G, Ladant D. Characterization of recombinant *Bordetella pertussis* adenylate cyclase toxins carrying passenger proteins. Res Microbiol 2001; 152: 889-900.

[9] de Sanjose S et al. Human papillomavirus genotype attribution in invasive cervical cancer: a retrospective cross-sectional worldwide study. Lancet Oncol 201011: 1048-56.

[10] Bruni L, Diaz M, Castellsague X, Ferrer E, Bosch F X, de Sanjose S. Cervical human papillomavirus prevalence in 5 continents: meta-analysis of 1 million women with normal cytological findings. J Infect Dis 2010 202: 1789-99.

[11] Morandell D, Rostek U, Bouvard V, Campo-Fernandez B, Fiedler M, Jansen-Durr P, Zwerschke W. Human papillomavirus type 45 E7 is a transforming protein inducing retinoblastoma protein degradation and anchorage-independent cell cycle progression. Virology 2008; 379: 20-9.

[12] Liu X, Clements A, Zhao K, Marmorstein R. Structure of the human Papillomavirus E7 oncoprotein and its mechanism for inactivation of the retinoblastoma tumour suppressor. J Biol Chem 2006; 281: 578-86.

[13] Liu S, Tian Y, Greenaway F T, Sun M Z. A C-terminal hydrophobic, solvent-protected core and a flexible N-terminus are potentially required for human papillomavirus 18 E7 protein functionality. Biochimie 2010 92: 901-8.

[14] El-Azami-El-Idrissi M, Bauche C, Loucka J, Osicka R, Sebo P, Ladant D, Leclerc C. Interaction of *Bordetella pertussis* adenylate cyclase with CD11b/CD18: Role of toxin acylation and identification of the main integrin interaction domain. J Biol Chem 2003; 278: 38514-21.

[15] Glaser P, Elmaoglou-Lazaridou A, Krin E, Ladant D, Barzu O, Danchin A. Identification of residues essential for catalysis and binding of calmodulin in *Bordetella pertussis* adenylate cyclase by site-directed mutagenesis. EMBO J 1989; 8: 967-72.

[16] Glaser P, Munier H, Gilles A M, Krin E, Porumb T, Barzu O, Sarfati R, Pellecuer C, Danchin A. Functional consequences of single amino acid substitutions in calmodulin-activated adenylate cyclase of *Bordetella pertussis*. EMBO J 1991; 10: 1683-8.

[17] De Villiers E M, Fauquet C, Broker T R, Bernard H U, & zur Hausen H (2004) *Virology* 324, 17-27

[18] Khafizov et al. A study of the evolution of inverted-topology repeats from LeuT-fold transporters using AlignMe. Biochemistry, 2010, 49; 10702-10713

[19] Lin K Y, Guarnieri F G, Staveley-O'Carroll K F, Levitsky H I, August J T, Pardoll D M, Wu T C. Treatment of established tumors with a novel vaccine that enhances major histocompatibility class II presentation of tumor antigen. Cancer Res 1996; 56: 21-6

[20] Bertram J S, Janik P. Establishment of a cloned line of Lewis Lung Carcinoma cells adapted to cell culture. Cancer Lett 1980; 11: 63-73.

[21] Savai R, Schermuly R T, Pullamsetti S S, Schneider M, Greschus S, Ghofrani H A, Traupe H, Grimminger F, Banat G A. A combination hybrid-based vaccination/adoptive cellular therapy to prevent tumor growth by involvement of T cells. Cancer Res 2007; 67: 5443-53.

[22] Barchet W, Oehen S, Klenerman P, Wodarz D, Bocharov G, Lloyd A L, Nowak M A, Hengartner H, Zinkernagel R M, Ehl S. Direct quantitation of rapid elimination of viral antigen-positive lymphocytes by antiviral CD8(+) T cells in vivo. Eur J Immunol 2000; 30: 1356-63.

[23] Ingulli E. Tracing tolerance and immunity in vivo by CFSE-labeling of administered cells. Methods Mol Biol 2007; 380: 365-76.

[24] Barber D L, Wherry E J, Ahmed R. Cutting edge: rapid in vivo killing by memory CD8 T cells. J Immunol 2003; 171: 27-31.

[25] Holubova et al. Delivery of large heterologous polypeptides across the cytoplasmic membrane of antigen-presenting cells by the *Bordetella* RTX hemolysin moiety lacking the adenylyl cyclase domain. Infect Immun. 2012 March; 80(3):1181-92.

SEQUENCE LISTING (79 sequences)

SEQ ID NO: 1 - DNA, 5121 bp, Bordetella pertussis (wild type CyaA)
  CDS (1)..(5121)
atgcagcaatcgcatcaggctggttacgcaaacgccgccgaccgggagtctggcatccccgcagccgtactcgatggcatcaaggccgtggcgaaggaaaaaaacgccacattgatgttccgcctggtcaacccccattccaccagcctgattgccgaaggggtggccaccaaaggattgggcgtgcacgccaagtcgtccgattgggggttgcaggcgggctacattcccgtcaacccgaatctttccaaactgttcggccgtgcgcccgaggtgatcgcgcgggccgacaacgacgtcaacagcagcctggcgcatggccataccgcggtcgacctgacgctgtcgaaagagcggcttgactatctgcggcaagcgggcctggtcaccggcatggccgatggcgtggtcgcgagcaaccacgcaggctacgagcagttcgagtttcgcgtgaaggaaacctcggacgggcgctatgccgtgcagtatcgccgcaagggcggcgacgatttcgaggcggtcaaggtgatcggcaatgccgccggtattccactgacggcggatatcgacatgttcgccattatgccgcatctgtccaacttccgcgactcggcgcgcagttcggtgaccagcggcgattcggtgaccgattacctggcgcgcacgcggcgggccgccagcgaggccacgggcggcctggatcgcgaacgcatcgacttgttgtggaaaatcgctcgcgccggcgcccgttccgcagtgggcaccgaggcgcgtcgccagttccgctacgacggcgacatgaatatcggcgtgatcaccgatttcgagctggaagtgcgcaatgcgctgaacaggcgggcgcacgccgtcggcgcgcaggacgtggtccagcatggcactgagcagaacaatcctttcccggaggcagatgagaagattttcgtcgtatcggccaccggtgaaagccagatgctcacgcgcgggcaactgaaggaatacattggccagcagcgcggcgagggctatgtcttctacgagaaccgtgcatacggcgtggcggggaaaagcctgttcgacgatgggctgggagccgcgcccggcgtgccgagcggacgttcgaagttctcgccggatgtactggaaacggtgccggcgtcacccggattgcggcggccgtcgctgggcgcagtggaacgccaggattccggctatgacagccttgatggggtgggatcgcgatcgttctcgttgggcgaggtgtccgacatggccgccgtggaagcggcggaactggaaatgacccggcaagtcttgcacgccggggcgcggcaggacgatgccgagccgggcgtgagcggtgcgtcggcgcactgggggcagcgggcgctgcagggcgcccaggcggtggcggcggcgcagcggctggttcatgccattgccctgatgacgcaattcggccgggccggttccaccaacacgccgcaggaagcggcctcgttgtcggcggccgtgttcggcttgggcgaggccagcagcgccgtggccgaaaccgtgagcggttttttccgcgggtcttcgcgctgggccggcggtttcggcgtggctggcggcgcgatggcgctgggaggcggcatcgccgcggccgttggcgccgggatgtcgttgaccgatgacgcgccggccggacagaaggccgccgccggcgccgagatcgcgctgcagttgacaggtggaacggtcgagctggcttcttccatcgcgttggcgctggccgcggcgcgcggcgtgaccagcggcttgcaggtggccggggcgtcggccggggcggctgccggcgcattggccgcggcgctcagtcccatggagatctacggcctggtgcagcaatcgcactatgcggatcagctggacaagctggcgcaggaatcgagcgcatacggttacgagggcgacgccttgctggcccagctgtatcgcgacaagacggccgccgagggcgccgtcgccggcgtctccgccgtcctgagcacggtgggggcggcggtgtcgatcgccgcggcggccagcgtggtaggggccccggtggcggtggtcacttccttgctgaccggggctctcaacggcatcctgcgcggcgtgcagcagcccatcatcgaaaagctggccaacgattacgctcgcaagatcgacgagctgggcgggccgcaagcgtacttcgagaaaaacctgcaggcgcgtcacgaacaactggccaattcggacggcctacggaaaatgctggccgacctgcaggccggttggaacgccagcagcgtgatcggggtgcagacgacagagatctccaagtcggcgctcgaactggccgccattaccggcaacgcggacaacctgaaatccgtcgacgtgttcgtggaccgcttcgtccagggcgagcgggtggccggccagccggtggtcctcgacgtcgccgccggcggcatcgatatcgccagccgcaagggcgagcggccggcgctgacgttcatcacgccgctggccgcgccaggagaagagcagcgccggcgcacgaaaacgggcaagagcgaattcaccacattcgtcgagatcgtgggcaagcaggaccgctggcgcatccgggacggcgcggccgacaccaccatcgatctggccaaggtggtgtcgcaactggtcgacgccaatggcgtgctcaagcacagcatcaaactggatgtgatcggcggagatggcgatgacgtcgtgcttgccaatgcttcgcgcatccattatgacggcggcgcgggcaccaacacggtcagctatgccgccctgggtcgacaggattccattaccgtgtccgccgacggggaacgtttcaacgtgcgcaagcagttgaacaacgccaacgtgtatcgcgaaggcgtggctacccagacaaccgcctacggcaagcgcacggagaatgtccaataccgccatgtcgagctggcccgtgtcgggcaactggtggaggtcgacacgctcgagcatgtgcagcacatcatcggcggggccggcaacgattcgatcaccggcaatgcgcacgacaacttcctagccggcgggtcgggcgacgacaggctggatggcggcgccggcaacgacaccctggttggcggcgagggccaaaacacggtcatcggcggcgccggcgacgacgtattcctgcaggacctgggggtatggagcaaccagctcgatggcggcgcgggcgtcgataccgtgaagtacaacgtgcaccagccttccgaggagcgcctcgaacgcatgggcgacacgggcatccatgccgatcttcaaaagggcacggtcgagaagtggccggccctgaacctgttcagcgtcgaccatgtcaagaatatcgagaatctgcacggctcccgcctgaacgaccgcatcgccggcgacgaccaggacaacgagctctggggccacgatggcaacgacacgatacgcggccggggcggcgacgacatcctgcgcggcggcctgggcctggacacgctgtatggcgaggacggcaacgacatcttcctgcaggacgacgagaccgtcagcgatgacatcgacggcggcgcggggctggacaccgtcgactactccgccatgatccatccaggcaggatcgttgcgccgcatgaatacggcttcgggatcgaggcggacctgtccagggaatgggtgcgcaaggcgtccgcgctgggcgtggactattacgataatgtccgcaatgtcgaaaacgtcatcggtacgagcatgaaggatgtgctcatcggcgacgcgcaagccaataccctgatgggccagggcggcgacgataccgtgcgcggcggcgacggcgatgatctgctgttcggcggcgacggcaacgacatgctgtatggcgacgccggcaacgacaccctctacggggggctgggcgacgatacccttgaaggcggcgcgggcaacgattggttcggccagacgcaggcgcgcgagcatgacgtgctgcgcggcggagatggggtggataccgtcgattacagccagaccggcgcgcatgccggcattgccgcgggtcgcatcgggctgggcatcctggctgacctgggcgccggccgcgtcgacaagctgggcgaggccggcagcagcgcctacgatacggtttccggtatcgagaacgtggtgggcacggaactggccgaccgcatcacgggcgatgcgcaggccaacgtgctgcgcggcgcgggtggcgccgacgtgcttgcgggcggcgagggcgacgatgtgctgctgggcggcgacggcgacgaccagctgtcgggcgacgccggacgcgatcgcttgtacggcgaagccggtgacgactggttcttccaggatgccgccaatgccggcaatctgctcgacggcggcgacggccgcgataccgtggatttcagcggcccgggccggggcctcgacgccggcgcaaagggcgtattcctgagcttgggcaaggggttcgccagcctgatggacgaacccgaaaccagcaacgtgttgcgcaatatcgagaacgccgtgggcagcgcgcgtgatgacgtgctgatcggcgacgcaggcgccaacgtcctcaatggcctggcgggcaacgacgtgctgtccggcggcgctggcgacgatgtgctgctgggcgacgagggctcggacctgctcagcggcgatgcgggcaacgacgatctgttcggcgggcagggcgatgatacttatctgttcggggtcgggtacgggcacgacacgatctacgaatcgggcggcggccatgacaccatccgcatcaacgcgggggcggaccagctgtggttcgcgcgccagggcaacgacctggagatccgcattctcggcaccgacgatgcacttaccgtgcacgactggtatcgcgacgccgatcaccgggtggaaatcatccatgccgccaaccaggcggtagaccaggcaggcatcgaaaagctggtcgaggcaatggcgcagtatccggaccccggcgcggcggcggctgccccgccggcggcgcgcgtgccggacacgctgatgcagtccctggctgtcaactggcgctga

SEQ ID NO: 2 - protein, 1706 aa, Bordetella pertussis (wild type CyaA)
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASEATGGLDRERIDLLWKIARAGARSAVGTEARRQFRYDGDMNIGVITDFELEVRNALNRRAHAVGAQDVVQHGTEQNNPFPEADEKIFVVSATGESQMLTRGQLKEYIGQQRGEGYVFYENRAYGVAGKSLFDDGLGAAPGVPSGRSKFSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 3 - DNA, 5121 bp, Bordetella hinzii (wild type CyaA); identical to SEQ ID NO: 1
  CDS (1)..(5121)

SEQ ID NO: 4 - protein, 1706 aa, Bordetella hinzii (wild type CyaA); identical to SEQ ID NO: 2

SEQ ID NO: 5 - DNA, 5121 bp, Bordetella parapertussis (wild type CyaA)
  CDS (1)..(5121)
atgcagcaatcgcatcaggctggttacgcaaacgccgccgaccgggagtctggcatccccgcagccgtactcgatggcatcaaggccgtggcgaaggaaaaaaacgccacattgatgttccgcctggtcaacccccattccaccagcctgattgccgaaggggtggccaccaaaggattgggcgtgcacgccaagtcgtccgattgggggttgcaggcgggctacattcccgtcaacccgaatctttccaaactgttcggccgtgcgcccgaggtgatcgcgcgggccgacaacgacgtcaacagcagcctggcgcatggccataccgcggtcgacctgacgctgtcgaaagagcggcttgactatctgcggcaagcgggcctggtcaccggcatggccgatggcgtggtcgcgagcaaccacgcaggctacgagcagttcgagtttcgcgtgaaggaaacctcggacgggcgctatgccgtgcagtatcgccgcaagggcggcgacgatttcgaggcggtcaaggtgatcggcaatgccgccggtattccactgacggcggatatcgacatgttcgccatcatgccgcatctgtccaacttccgcgactcggcgcgcagttcggtgaccagcggcgattcggtgaccgattacctggcgcgcacgcggcgggccgccagcgaggccacgggcggcctggatcgcgaacgcatcgacttgttgtggaaaatcgctcgcgccggcgcccgttccgcagtgggcaccgaggcgcgtcgccagttccgctacgacggcgacatgaatatcggcgtgatcaccgatttcgagctggaagtgcgcaatgcgctgaacaggcgggcgcacgccgtcggcgcgcaggacgtggtccagcatggcactgagcagaacaatcctttcccggaggcagatgagaagattttcgtcgtatcggccaccggtgaaagccagatgctcacgcgcgggcaactgaaggaatacattggccagcagcgcggcgagggctatgtcttctacgagaaccgtgcatacggcgtggcggggaaaagcctgttcgacgatgggctgggagccgcgcccggcgtgccgggcggacgttcgaagtcctcgccggatgtactggaaacggtgccggcgtcacccggattgcggcggccgtcgctgggcgcagtggaacgccaggattccggctatgacagccttgatggggtgggatcgcgatcgttctcgttgggcgaggtgtccgacatggccgccgtggaagcggcggaactggaaatgacccggcaagtcttgcacgccggggcgcggcaggacgatgccgagccgggcgtgagcggtgcgtcggcgcactgggggcagcgggcgctgcagggcgcccaggcggtggcggcggcgcagcggctggttcatgccattgccctgatgacgcaattcggccgggccggttccaccaacacgccgcaggaagcggcctcgttgtcggcggccgtgttcggcttgggcgaggccagcagcgccgtggccgaaaccgtgagcggttttttccgcgggtcttcgcgctgggccggcggtttcggcgtggctggcggcgcgatggcgctgggaggcggcatcgccgcggccgttggcgccgggatgtcgttgaccgatgacgcgccggccggacagaaggccgccgtcggcgccgagatcgcgctgcagttgacaggtggaacggtcgagctggcttcttccatcgcgttggcgctggccgcggcgcgcggcgtgaccagcggcttgcaggtggcgggggcgtcggccggggcggctgccggcgcattggccgcggcgctcagtcccatggagatctacggcctggtgcagcaatcgcactatgcggatcagctggacaagctggcgcaggaatcgagcgcatacggttacgagggcgacgccttgctggcccagctgtatcgcgacaagacggccgccgagggcgccgtcgccggcgtctccgccgtcctgagcacggtgggggcggcggtgtcgatcgccgcggcggccagcgtggtaggcgccccggtggcggtggtcacttccttgttgaccggggctctcaacggcatcctgcgcggcgtgcagcagcccatcatcgaaaagctggccaatgattacgctcgcaagatcgacgagctgggcgggccgcaagcgtacttcgagaaaaacctgcaggcgcgtcacgaacaactggccaattcggacggcctacggaaaatgctggctgacctgcaggccgggtggaacgccagcagcgtgatcggggtgcagacgacagagatttccaagtcggcgctcgaactggccgccattaccggcaacgcggacaacctgaaatccgccgacgtgttcgtggaccgcttcatccagggcgagcgggtggccggccagccggtggtactcgacgtcgccgccggcggcatcgatatcgccagccgcaagggcgagcggccggcgctgacgttcatcacgccgctggccgcgccaggagaagagcagcgccggcgcacgaagacgggcaagagcgaattcaccacattcgtcgagatcgtgggcaagcaggaccgctggcgcatccgggacggcgcggccgacaccaccatcgatctggccaaggtggtgtcgcaactggtcgacgccaatggcgtgctcaagcacagcatcaaactggaggtgatcggcggagatggcgatgatgtcgtgcttgccaatgcttcgcgcatccattacgacggcggcgcgggaaccaacacggtcagctatgccgccctgggccgacaggattccattaccgtgtccgccgacggggaacgtttcaacgtgcgcaagcagttgaacaacgccaacgtgtatcgcgaaggcgtggctacccagaaaaccgcctacggcaagcgcacggagaatgtccaataccgccatgtcgagctggcccgtgtcgggcaactggtggaggtcgacacgctcgagcatgtgcagcacatcatcggcggggccggcaacgattcgatcaccggcaatgcgcacgacaacttcctggccggcggggcgggcgacgacaggctggatggcggcgccggcaacgacacactggtcggcggcgagggccacaacacggtcgtcggcggcgctggcgacgacgtattcctgcaggacctgggggtatggagcaaccagctcgatggcggcgcgggcgtcgataccgtgaagtacaacgtgcaccagccttccgaggaacgcctcgaacgcatgggcgacacgggcatccatgccgatcttcaaaagggcacggtcgagaagtggccggccctgaacctgttcagcgtcgaccatgtcaagaatatcgagaatctgcacggctccagcctgaacgacagcatcgccggcgacgaccgggacaacgagctctggggcgacgatggcaacgacacgatacacggccggggcggcgacgatatcctgcgcggcggcctgggcctggacacgctgtatggcgaggacggcaacgacatcttcctgcaggacgacgagaccgtcagcgatgacatcgacggcggcgcggggctggacaccgtcgactattccgccatgatccatgcaggcaagatcgttgcgccgcatgaatacggcttcgggatcgaggcggacctgtccgaagggtgggtgcgcaaggcggcccggcgcggcatgggctactacgacagtgtccgcagtgtcgaaaacgtcatcggcacgagcatgaaggatgtgctcatcggcgacgcgcaagccaataccctgatgggccagggcggcgacgataccgtgcgcggcggcgacggcgatgatctgctgttcggcggcgacggcaacgacatgctgtatggagacgccggcaacgacaccctctacggagggctgggcgacgatacccttgaaggcggcgcgggcaacgattggttcggccagacgccggcgcgcgagcatgacgtgctgcgcggcggggctggggtggataccgtggattacagccaggcgggcgcgcatgccggcgttgccacgggtcgcatcgggctgggtattctggcggacctgggcgccggccgcgtcgacaagctgggcgaggccggcagcagcgcctacgatacggtttccggcatcgaaaatgtggtgggcacggaactggccgaccgcatcacgggcgatgcgcaggccaacgtactgcgcggcgcgggtggtgccgacgtgcttgcgggcggcgagggcgacgatgtgctgctgggcggcgagggcgatgaccagctgtcgggcgacgccggacgcgaccgcttgtacggcgaagccggtgacgactggttcttccaggatgccgccaatgccggcaatctgctcgacggtggtgacggcaacgataccgtggatttcagcggcccgggccggggcctcgacgccggcgcaaagggcgtattcctgagcctgggcaaggggttcgccagcctgatggacgaacccgaaaccagcaacgtgttgcgccatatcgagaacgccgtgggcagcgtgcgtgatgacgtgctgatcggcgacgcaggcgccaacgtcctcaatggcctggcgggcaacgacgtgttgtccggcggcgccggcgacgatgtgctgctgggcgacgagggctcggacctgctcagcggcgatgcgggcaacgacgatctgttcggcgggcagggcgatgatacctatctgttcggggccgggtacggacatgacacgatctacgaatcgggcggcggccatgacaccatccgtatcaacgcgggggcggaccagctgtggtttgcgcgccagggcaacgacctggagatccgcattcttggcaccgacgatgcacttaccgtgcacgactggtatcgcgacgccgatcaccgggtggaagccatccatgccgccaaccaggccatagacccggccggcatcgaaaagctggtcgaggcaatggcgcagtacccggaccccggcgcggcggcggctgccccgccggcggcgcgcgtgccggacacgctgatgcagtccctggctgtcaactggcgctga

SEQ ID NO: 6 - protein, 1706 aa, Bordetella parapertussis (wild type CyaA)
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASEATGGLDRERIDLLWKIARAGARSAVGTEARRQFRYDGDMNIGVITDFELEVRNALNRRAHAVGAQDVVQHGTEQNNPFPEADEKIFVVSATGESQMLTRGQLKEYIGQQRGEGYVFYENRAYGVAGKSLFDDGLGAAPGVPGGRSKSSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAVGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMGYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGEGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 7 - DNA, 5118 bp, Bordetella bronchiseptica (wild type CyaA)
  CDS (1)..(5118)
atgcagcaatcgcatcaggctggttacgcaaacgccgccgaccgggagtctggcatccccgcagccgtactcgatggcatcaaggccgtggcgaaggaaaaaaacgccacattgatgttccgcctggtcaacccccattccaccagcctgattgccgaaggggtggccaccaaaggattgggcgtgcacgccaagtcgtccgattgggggttgcaggcgggctacattcccgtcaacccgaatctttccaaactgttcggccgtgcgcccgaggtgatcgcgcgggccgacaacgacgtcaacagcagcctggcgcatggccataccgcggtcgacctgacgctgtcgaaagagcggcttgactatctgcggcaagcgggcctggtcaccggcatggccgatggcgtggtcgcgagcaaccacgcaggctacgagcagttcgagtttcgcgtgaaggaaacctcggacgggcgctatgccgtgcagtatcgccgcaagggcggcgacgatttcgaggcggtcaaggtgatcggcaatgccgccggtattccactgacggcggatatcgacatgttcgccatcatgccgcatctgtccaacttccgcgactcggcgcgcagttcggtgaccagcggcgattcggtgaccgattacctggcgcgcacgcggcgggccgccagcgaggccacgggcggcctggatcgcgaacgcatcgacttgttgtggaaaatcgctcgcgccggcgcccgttccgcagtgggcaccgaggcgcgtcgccagttccgctacgacggcgacatgaatatcggcgtgatcaccgatttcgagctggaagtgcgcaatgcgctgaacaggcgggcgcacgcggtcggcaggcaggacgtggtccagcatggcactgagcagaacaatcctttcccggaggcagatgagaagattttcgtcgtatcggccaccggtgaaagccagatgctcacgcgcgggcaactgaaggaatacattggccagcagcgcggcgagggctatgtcttctacgagaaccgtgcgtacggcgtggcggggaaaagcctgttcgacgatgggctgggagccgcgcccggcgtgccggggcgacgttcgaagtcctcgccggatgtactggaaacggtgccggcgtcacccggattgcggcggccgtcgctgggcgcagtggaacgccaggattccggctatgacagccttgatggggtgggatcgcgatcgttctcgttgggcgaggtgtccgacatggccgccgtggaagcggcggaactggaaatgacccggcaagtcttgcacgccggggcgcggcaggacgatgccgagccgggcgtgagcggtgcgtcggcgcactgggggcagcgggcgctgcagggcgcccaggcggtggcggcggcgcagcggctggttcatgccattgccctgatgacgcaattcggccgggccggttccaccaacacgccgcaggaagcggcctcgttgtcggcggccgtgttcggcttgggcgaggccagcagcgccgtggccgaaaccgtgagcggttttttccgcgggtcttcgcgctgggccggcggtttcggcgtggctggcggcgcgatggcgctgggaggcggcatcggcgccgttggcgccgggatgtcgttgaccgatgacgcgccggccggacagaaggccgccgccggcgccgagatcgcgctgcagttgacaggtggaacggtcgagctggcttcttccatcgcgttggcgctggccgcggcgcgcggcgtgaccagcggcttgcaggtggcgggggcgtcggccggggcggctgccggcgcattggccgcggcgctcagtcccatggagatctacggcctggtgcagcaatcgcactatgcggatcagctggacaagctggcgcaggaatcgagcgcatacggttacgagggcgacgccttgctggcccagctgtatcgcgacaagacggccgccgagggcgccgtcgccggcgtctccgccgtcctgagcacggtgggggctgcggtgtcgatcgccgcggcggccagcgtggtaggcgccccggtggcggtggtcacttccttgttgaccggggctctcaacggcatcctgcgcggcgtgcagcagcccatcatcgaaaagctggccaatgattacgctcgcaagatcgacgagctgggcgggccgcaagcgtacttcgagaaaaacctgcaggcgcgtcacgaacaactggccaattcggacggcctacggaaaatgctggccgacctgcaggccgggtggaacgccagcagcgtgatcggggtgcagacgacagagatttccaagtcggcgctcgaactggccgccattaccggcaacgcggacaacctgaaatccgccgacgtgttcgtggaccgcttcatccagggcgagcgggtggccggccagccggtggtactcgacgtcgccgccggcggcatcgatatcgccagccgcaagggcgagcggccggcgctgacgttcatcacgccgctggccgcgccaggagaagagcagcgccggcgcacgaaaacgggcaagagcgaattcaccacattcgtcgagatcgtgggcaagcaggaccgctggcgcatccgggacggcgcggccgacaccaccatcgatctggccaaggtggtgtcgcaactggtcgacgccaatggcgtgctcaagcacagcatcaaactggaggtgatcggcggagatggcgatgatgtcgtgcttgccaatgcttcgcgcatccattacgacggcggcgcgggaaccaacacggtcagctatgccgccctgggccgacaggattccattaccgtgtccgccgacggggaacgtttcaacgtgcgcaagcagttgaacaacgccaacgtgtatcgcgaaggcgtggctacccagaaaaccgcctacggcaagcgcacggagaatgtccaataccgccatgtcgagctggcccgtgtcgggcaactggtggaggtcgacacgctcgagcatgtgcagcacatcatcggcggggccggcaacgattcgatcaccggcaatgcgcacgacaacttcctggccggcggggcgggcgacgacaggctggatggcggcgccggcaacgacacactggtcggcggcgagggccacaacacggtcgtcggcggcgctggcgacgacgtattcctgcaggacctgggggtatggagcaaccagctcgatggcggcgcgggcgtcgataccgtgaagtacaacgtgcaccagccttccgaggaacgcctcgaacgcatgggcgacacgggcatccatgccgatcttcaaaagggcacggtcgagaagtggccggccctgaacctgttcagcgtcgaccatgtcaagaatatcgagaatctgcacggctccagcctgaacgacagcatcgccggcgacgaccgggacaacgagctctggggcgacgatggcaacgacacgatacacggccggggcggcgacgatatcctgcgcggcggcctgggcctggacacgctgtatggcgaggacggcaacgacatcttcctgcaggacgacgagaccgtcagcgatgacatcgacggtggcgcgggactggacaccgtcgactattccgccatgatccatgcaggcaagatcgttgcgccgcatgaatacggcttcgggatcgaggcggacctgtccgaagggtgggtgcgcaaggcggcccggcgcggcatggactactacgacagtgtccgcagtgtcgaaaacgtcatcggcacgagcatgaaggatgtgctcatcggcgacgcgcaagccaataccctgatgggccagggcggcgacgataccgtgcgcggcggcgacggcgatgatctgctgttcggcggcgacggcaacgacatgctgtatggagacgccggcaacgacaccctctacggagggctgggcgacgatacccttgaaggcggcgcgggcaacgattggttcggccagacgccggcgcgcgagcatgacgtgctgcgcggcggggctggggtggataccgtggattacagccaggcgggcgcgcatgccggcgttgccacgggtcgcatcgggctgggtattctggcggacctgggcgccggccgcgtcgacaagctgggcgaggccggcagcagcgcctacgatacggtttccggcatcgaaaatgtggtgggcacggaactggccgaccgcatcacgggcgatgcgcaggccaacgtactgcgcggcgcgggtggcgccgacgtgcttgcgggcggcgagggcgacgatgtgctgctgggcggcgacggcgacgaccagctgtcgggcgacgccggacgcgaccgcttgtacggcgaagccggtgacgactggttcttccaggatgccgccaatgccggcaatctgctcgacggtggtgacggcaacgataccgtggatttcagcggcccgggccggggcctcgacgccggcgcaaagggcgtattcctgagcctgggcaaggggttcgccagcctgatggacgaacccgaaaccagcaacgtgttgcgccatatcgagaacgccgtgggcagcgtgcgtgatgacgtgctgatcggcgacgcaggcgccaacgtcctcaatggcctggcgggcaacgacgtgctgtccggcggcgccggcgacgatgtgctgctgggcgacgagggctcggacctgctcagcggcgatgcgggcaacgacgatctgttcggcgggcagggcgatgatacctatctgttcggggccgggtacggacatgacacgatctacgaatcgggcggcggccatgacaccatccgtatcaacgcgggggcggaccagctgtggtttgcgcgccagggcaacgacctggagatccgcattcttggcaccgacgatgcacttaccgtgcacgactggtatcgcgacgccgatcaccgggtggaagccatccatgccgccaaccaggccatagacccggccggcatcgaaaagctggtcgaggcaatggcgcagtacccggaccccggcgcggcggcggctgccccgccggcggcgcgcgtgccggacacgctgatgcagtccctggctgtcaactggcgctga

SEQ ID NO: 8 - protein, 1705 aa, Bordetella bronchiseptica (wild type CyaA)
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASEATGGLDRERIDLLWKIARAGARSAVGTEARRQFRYDGDMNIGVITDFELEVRNALNRRAHAVGRQDVVQHGTEQNNPFPEADEKIFVVSATGESQMLTRGQLKEYIGQQRGEGYVFYENRAYGVAGKSLFDDGLGAAPGVPGRRSKSSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIGAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMDYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 9 - DNA, 4842 bp, Artificial Sequence
  Nucleotide sequence encoding polypeptide 1-227 + 321-1706 of SEQ ID NO:2
  CDS (1)..(4842)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctgaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 10 - protein, 1613 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASESQMLTRGQLKEYIGQQRGEGYVFYENRAYGVAGKSLFDDGLGAAPGVPSGRSKFSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 11 - DNA, 4512 bp, Artificial Sequence
  Nucleotide sequence encoding polypeptide 1-183 + 387-1706 of SEQ ID NO:2
  CDS (1)..(4512)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 12 - protein, 1503 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 13 - protein, 1613 aa, Artificial Sequence; identical to SEQ ID NO: 10
  Polypeptide 1-227 + 321-1706 of SEQ ID NO: 4

SEQ ID NO: 14 - protein, 1503 aa, Artificial Sequence; identical to SEQ ID NO: 12
  Polypeptide 1-183 + 387-1706 of SEQ ID NO:4

SEQ ID NO: 15 - protein, 1613 aa, Artificial Sequence
  Polypeptide 1-227 + 321-1706 of SEQ ID NO:6
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASESQMLTRGQLKEYIGQQRGEGYVFYENRAYGVAGKSLFDDGLGAAPGVPGGRSKSSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAVGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMGYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGEGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 16 - protein, 1503 aa, Artificial Sequence
  Polypeptide 1-183 + 387-1706 of SEQ ID NO:6
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAVGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMGYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGEGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 17 - protein, 1612 aa, Artificial Sequence
  Polypeptide 1-227 + 321-1705 of SEQ ID NO:8
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASESQMLTRGQLKEYIGQQRGEGYVFYENRAYGVAGKSLFDDGLGAAPGVPGRRSKSSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIGAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMDYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 18 - protein, 1502 aa, Artificial Sequence
  Polypeptide 1-183 + 387-1705 of SEQ ID NO:8
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIGAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSADVFVDRFIQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLEVIGGDGDDVVLANASRIHYDGGAGTNTVSYAALGRQDSITVSADGERFNVRKQLNNANVYREGVATQKTAYGKRTENVQYRHVELARVGQLVEVDTLEHVQHIIGGAGNDSITGNAHDNFLAGGAGDDRLDGGAGNDTLVGGEGHNTVVGGAGDDVFLQDLGVWSNQLDGGAGVDTVKYNVHQPSEERLERMGDTGIHADLQKGTVEKWPALNLFSVDHVKNIENLHGSSLNDSIAGDDRDNELWGDDGNDTIHGRGGDDILRGGLGLDTLYGEDGNDIFLQDDETVSDDIDGGAGLDTVDYSAMIHAGKIVAPHEYGFGIEADLSEGWVRKAARRGMDYYDSVRSVENVIGTSMKDVLIGDAQANTLMGQGGDDTVRGGDGDDLLFGGDGNDMLYGDAGNDTLYGGLGDDTLEGGAGNDWFGQTPAREHDVLRGGAGVDTVDYSQAGAHAGVATGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGNDTVDFSGPGRGLDAGAKGVFLSLGKGFASLMDEPETSNVLRHIENAVGSVRDDVLIGDAGANVLNGLAGNDVLSGGAGDDVLLGDEGSDLLSGDAGNDDLFGGQGDDTYLFGAGYGHDTIYESGGGHDTIRINAGADQLWFARQGNDLEIRILGTDDALTVHDWYRDADHRVEAIHAANQAIDPAGIEKLVEAMAQYPDPGAAAAAPPAARVPDTLMQSLAVNWR

SEQ ID NO: 19 - protein, 1547 aa, Artificial Sequence
  Polypeptide 1-227 + 387-1706 of SEQ ID NO:2
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 20 - protein, 1569 aa, Artificial Sequence
  polypeptide 1-183 + 321-1706 of SEQ ID NO:2
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIESQMLTRGQLKEYIGQQRGEGYVFYENRAYGVAGKSLFDDGLGAAPGVPSGRSKFSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 21 - DNA, 558 bp, Bordetella pertussis
atgcttccgtccgcccaagcgccctccctcctcaatcccaccgacgacttcgcggcactgggcaatattgcctggctgtggatgaactctcccatgcaccgcgactggccggtgcatctgctcgcacgcaacacgctcgcgccgattcaactgggccaatacattctgctgcgatgcaatgacgtgccggttgcatactgcagctgggccctaatggacgccgacaccgaactctcctatgtcatggcgccctcgtcgctgggcgggaatgcctggaactgcggcgaccgactgtggatcatcgactggatcgcgccattctcgcgcgacgacaatcgtgcgctgcgccgcgcgctggccgaacggcaccccgacagcgtgggccgttcgctgcgcgttcggcgcggcggcgacaccgcgcgcgtcaaggagtaccgaggccgcgcgctggacgcggccgccgctcgcgcgcagctggaccgctaccatgccgaactgatcgcaggactgcgcgcgagcaacggcggatacgcgccgcgaggccggggcaccgcctga

SEQ ID NO: 22 - DNA, 558 bp, Artificial Sequence
  Optimized version of CyaC nucleotide coding sequence
  CDS (1)..(558)
atgctgccgtctgcacaggcgccgtctctgctgaatccaactgatgacttcgctgcgctgggtaacatcgcgtggctgtggatgaacagcccgatgcaccgtgactggccggttcacctgctggcacgtaacacgctggcgccgatccagctgggtcaatacatcctgctgcgttgtaacgacgtgcctgtggcgtattgctcctgggcactgatggatgcggataccgagctgtcctacgttatggccccatctagcctgggcggtaacgcttggaactgcggcgatcgtctgtggatcattgattggattgctccgtttagccgtgacgacaaccgtgctctgcgtcgcgcgctggccgaacgtcatccggattctgttggccgttccctgcgcgtacgtcgcggtggcgacaccgctcgcgtcaaagaataccgtggtcgtgctctggacgcagcggcggcccgcgctcagctggaccgctaccacgcagaactgattgccggtctgcgtgcatccaatggcggttatgctccgcgtggccgtggcaccgcataa

SEQ ID NO: 23 - protein, 185 aa, Artificial Sequence
  Synthetic Construct
MLPSAQAPSLLNPTDDFAALGNIAWLWMNSPMHRDWPVHLLARNTLAPIQLGQYILLRCNDVPVAYCSWALMDADTELSYVMAPSSLGGNAWNCGDRLWIIDWIAPFSRDDNRALRRALAERHPDSVGRSLRVRRGGDTARVKEYRGRALDAAAARAQLDRYHAELIAGLRASNGGYAPRGRGTA

SEQ ID NO: 24 - protein, 441 aa, Artificial Sequence
  Model antigen (peptide 105)
MGIRSRDHMVLHEYVNAAGITGSDRMEVGWYRSPFSRVVHLYRNGKSIINFEKLVRVDMVRHRIKEHMLKKYTQIYSTVASSLSGEKISQAVHAAHAEINEAGRELAGIGILTVPKYVKQNTLKLATKAVYNFATCSGRKVAELVHFLLLKYRAREPVTKAEMLGSVVGNWQYFFPVIFSKASSSLQLVFGIELMEVDPIGHLYIFATKLLTQHFVQENYLEYRQVPGSDPACYEFLWGPRALVETSYVKTGMHGDTPTLHEYMLDLQPETTDLYCYEQLNGPAGQAEPDRAHYNIVTFCCKCDSTLRLCVQSTHVDIRTLEDLLMGTLGIVCPICSQKPMHGPKATLQDIVLHLEPQNEIPVDLLCHEQLSASGVNHQHLPARRAEPQRHTMLCMCCKCEARIELVVESSADDLRAFQQLFLNTLSFVCPWCASQQLKGP

SEQ ID NO: 25 - protein, 98 aa, Artificial Sequence
  Protein sequence of E7 of HPV16
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 26 - protein, 105 aa, Artificial Sequence
  Protein sequence of E7 of HPV18
MHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQ

SEQ ID NO: 27 - protein, 98 aa, Artificial Sequence
  Protein sequence of E7 of HPV31
MRGETPTLQDYVLDLQPEATDLYCYEQLPDSSDEEDVIDSPAGQAKPDTSNYNIVTFCCQCESTLRLCVQSTQVDIRILQELLMGSFGIVCPNCSTRL

SEQ ID NO: 28 - protein, 97 aa, Artificial Sequence
  Protein sequence of E7 of HPV33
MRGHKPTLKEYILDLYPEPTDLYCYEQLSDSSDEDEGLDRPDGQAQPATADYYIVTCCHTCNTTVRLCVNSTASDLRTIQQLLMGTVNIVCPSCAQL

SEQ ID NO: 29 - protein, 106 aa, Artificial Sequence
  Protein sequence of E7 of HPV45
MHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQ

SEQ ID NO: 30 - protein, 99 aa, Artificial Sequence
  Protein sequence of E7 of HPV52
MRGDKATIKDYILDLQPETTDLHCYEQLGDSSDEEDTDGVDRPDGQAEQATSNYYIVTYCHSCDSTLRLCIHSTATDLRTLQQMLLGTLQVVCPGCARL

SEQ ID NO: 31 - protein, 99 aa, Artificial Sequence
  Modified version of protein sequence of E7 of HPV52
MRGDKATIKDYILDLQPETTDLHCYEQLGDSSDEEDTDGVDRPDGQAEQATSNYYIVTYCHSCDSTLRLCIHSTATDLRTLQQLLMGTLQVVCPGCARL

SEQ ID NO: 32 - protein, 98 aa, Artificial Sequence
  Protein sequence of E7 of HPV 58
MRGNNPTLREYILDLHPEPTDLFCYEQLCDSSDEDEIGLDRPDGQAQPATANYYIVTCCYTCDTTVRLCINSTTTDVRTLQQLLMGTCTIVCPSCAQQ

SEQ ID NO: 33 - DNA, 828 bp, Artificial Sequence
  polynucleotide for antigen E7 of HPV16, HVP18 and HPV45 acidic-deleted
  CDS (1)..(828)
ggtcaggcggaaccggatcgcgcgcactacaacatcgttactttttgttgcaaatgtgattccactctgcgcctgtgtgtgcaatccacccacgtagacattcgcactctggaagacctgctgatgggtacccttggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtatcgagctggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctg

SEQ ID NO: 34 - protein, 276 aa, Artificial Sequence
  Synthetic Construct
GQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQGVSHAQLPARRAEPQRHKILCVCCKCDGRIELTVESSAEDLRTLQQLFLSTLSFVCPWCATNQMHGDTPTLHEYMLDLQPETTDLYCYEQLNMHGPKATLQDIVLHLEPQNEIPVDLLCHEQLMHGPRETLQEIVLHLEPQNELDPVDLLCYEQL

SEQ ID NO: 35 - DNA, 933 bp, Artificial Sequence
  Polynucleotide for antigen E7 of HPV16, HPV18 and HPV45 full
  CDS (1)..(933)
gaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcataccatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaaatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaa

SEQ ID NO: 36 - protein, 311 aa, Artificial Sequence
  Synthetic Construct
EDEIDGPAGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQENDEADGVSHAQLPARRAEPQRHKILCVCCKCDGRIELTVESSAEDLRTLQQLFLSTLSFVCPWCATNQMHGDTPTLHEYMLDLQPETTDLYCYEQLNDSSEEMHGPKATLQDIVLHLEPQNEIPVDLLCHEQLSDSEEENDEIDMHGPRETLQEIVLHLEPQNELDPVDLLCYEQLSESEE

SEQ ID NO: 37 - DNA, 1011 bp, Artificial Sequence
  polynucleotide for antigen E7 of HPV31, 33, 52 and 58 acidic-deleted
  CDS (1)..(1011)
gcgggtcaagcgaagccggatacgagcaactataacattgtcacgttctgctgccagtgtgaaagcaccttgcgtctgtgtgtccagagcacccaagttgacatccgtattctgcaggagttgctgatgggcagctttggcatcgtgtgcccgaattgcagcactcgcctgggtcaggcacagccggccaccgctgactactacattgttacttgttgccatacctgcaataccacggtccgcctgtgcgtcaattccaccgcttccgacttgcgtaccattcagcaactgctgatgggcacggttaacatcgtttgcccgtcttgtgcgcagctgggccaagcggaacaggcgacgagcaattactacatcgtgacttactgtcactcgtgtgacagcacgctgcgtttgtgcattcacagcaccgcgaccgatctgcgtacgctgcaacaattgctgatgggtaccctgcaggtggtgtgccctggttgcgcacgtctgggtcaagctcaaccggcaaccgcgaactactatatcgttacgtgttgttatacgtgtgataccaccgttcgtctgtgcatcaacagcaccaccaccgatgtccgcacgctgcaacaactgctgatgggtacgtgtacgattgtttgcccgagctgtgcccagcaaatgcgtggtgaaaccccaacgctgcaggactacgtgctggatttgcagccggaagcaaccgacctgtactgctacgagcagctgatgcgtggtcacaagccgacgctgaaagagtatatcttggacctgtatccggagcctaccgatctgtattgctatgaacagctgagcatgcgtggcgataaggcgaccatcaaagactacattctggacttgcagccggaaaccacggatctgcattgctacgaacaactgggcatgcgcggtaacaatccgaccctgcgcgagtatatcctggatctgcacccagagccgactgacctgttctgctatgagcagttgtgc

SEQ ID NO: 38 - protein, 337 aa, Artificial Sequence
  Synthetic Construct
AGQAKPDTSNYNIVTFCCQCESTLRLCVQSTQVDIRILQELLMGSFGIVCPNCSTRLGQAQPATADYYIVTCCHTCNTTVRLCVNSTASDLRTIQQLLMGTVNIVCPSCAQLGQAEQATSNYYIVTYCHSCDSTLRLCIHSTATDLRTLQQLLMGTLQVVCPGCARLGQAQPATANYYIVTCCYTCDTTVRLCINSTTTDVRTLQQLLMGTCTIVCPSCAQQMRGETPTLQDYVLDLQPEATDLYCYEQLMRGHKPTLKEYILDLYPEPTDLYCYEQLSMRGDKATIKDYILDLQPETTDLHCYEQLGMRGNNPTLREYILDLHPEPTDLFCYEQLC

SEQ ID NO: 39 - DNA, 1176 bp, Artificial Sequence
  polynucleotide for antigen E7 of HPV31, 33, 52 and 58 full
  CDS (1)..(1176)
gatgaagaggatgtcatcgattccccagcaggccaagcaaagccggacaccagcaattacaatatcgtgaccttctgctgccaatgtgagtccactctgcgtctgtgcgttcagagcacccaggttgacattcgtattctgcaagaattgttgatgggtagctttggcattgtgtgtccgaactgcagcacccgtctgtcggatgaagatgaaggtctggatcgtccggatggtcaagcgcagccggcgactgcagattactatatcgtcacttgttgccacacctgcaataccaccgtgcgtctgtgtgtgaacagcacggcgagcgacctgcgcacgatccaacagttgttgatgggcaccgtgaatatcgtctgcccaagctgtgctcagttgagcgatgaagaggacaccgacggtgtcgaccgtccggacggccaagctgagcaggcgaccagcaactactatatcgttacgtactgtcacagctgcgatagcactctgcgcctgtgtattcatagcacggccaccgatctgcgtaccctgcaacaactgctgatgggtactctgcaggttgtgtgcccaggttgtgctcgtctgtccgacgaggacgaaatcggcctggaccgtcctgatggccaggcccagccggcaacggcgaactattacattgtgacctgctgctatacgtgcgataccacggtccgtctgtgcattaactctaccaccacggatgttcgcacgctgcagcaactgctgatgggtacctgtaccattgtttgcccgtcttgtgcccagcagatgcgcggtgaaacgccgaccctgcaggattatgttctggacctgcaaccggaggcgaccgatctgtattgctacgagcaactgccggacagctcgatgcgtggtcacaaaccgacgctgaaagagtacatcctggacctgtacccggaacctacggatctgtactgttatgaacaactgagcgatagcatgcgtggtgacaaggcgacgattaaggactacatcttggatctgcagccggaaaccaccgacctgcactgctatgagcagctgggtgattctatgcgcggtaacaatccgaccctgcgcgagtacattctggacttgcatccggaaccgacggacctgttctgttacgagcagctgtgtgacagc

SEQ ID NO: 40 - protein, 392 aa, Artificial Sequence
  Synthetic Construct
DEEDVIDSPAGQAKPDTSNYNIVTFCCQCESTLRLCVQSTQVDIRILQELLMGSFGIVCPNCSTRLSDEDEGLDRPDGQAQPATADYYIVTCCHTCNTTVRLCVNSTASDLRTIQQLLMGTVNIVCPSCAQLSDEEDTDGVDRPDGQAEQATSNYYIVTYCHSCDSTLRLCIHSTATDLRTLQQLLMGTLQVVCPGCARLSDEDEIGLDRPDGQAQPATANYYIVTCCYTCDTTVRLCINSTTTDVRTLQQLLMGTCTIVCPSCAQQMRGETPTLQDYVLDLQPEATDLYCYEQLPDSSMRGHKPTLKEYILDLYPEPTDLYCYEQLSDSMRGDKATIKDYILDLQPETTDLHCYEQLGDSMRGNNPTLREYILDLHPEPTDLFCYEQLCDS

SEQ ID NO: 41 - DNA, 759 bp, Artificial Sequence
  polynucleotide for antigen E7 of HPV31, 52 and 58 acidic-deleted
  CDS (1)..(759)
gcgggtcaagccaaaccggatacctccaactacaacattgtgaccttctgttgtcaatgcgagagcacgctgcgtctgtgtgttcaaagcacccaggttgacattcgtatcctgcaagaactgctgatgggctcttttggcatcgtctgcccaaattgcagcactcgcctgggccaggcggagcaggcgacgagcaactactacattgtcacgtattgccattcctgtgatagcactctgcgtctgtgtatccacagcacggcaaccgatctgcgtaccttgcaacaactgctgatgggcaccctgcaggtggtttgtccgggttgcgctcgcctgggccaggcgcagccagcgacggccaattactacatcgttacctgttgctatacgtgcgatactaccgtccgtctgtgcattaacagcaccaccacggacgtgcgtaccctgcaacagctgctgatgggtacctgcacgattgtttgtccgagctgtgcacaacaaatgcgtggtgaaacgccgaccctgcaggattatgtgttggacttgcagccggaggcaacggacctgtactgctatgagcagctgatgcgtggtgacaaggccaccattaaagattacatcctggacttgcaaccggaaaccaccgacctgcactgctatgagcagctgggtatgcgcggtaataacccgaccttgcgtgagtatatcttggacctgcacccggagccgaccgatctgttctgttacgaacagctgtgc

SEQ ID NO: 42 - protein, 253 aa, Artificial Sequence
  Synthetic Construct
AGQAKPDTSNYNIVTFCCQCESTLRLCVQSTQVDIRILQELLMGSFGIVCPNCSTRLGQAEQATSNYYIVTYCHSCDSTLRLCIHSTATDLRTLQQLLMGTLQVVCPGCARLGQAQPATANYYIVTCCYTCDTTVRLCINSTTTDVRTLQQLLMGTCTIVCPSCAQQMRGETPTLQDYVLDLQPEATDLYCYEQLMRGDKATIKDYILDLQPETTDLHCYEQLGMRGNNPTLREYILDLHPEPTDLFCYEQLC

SEQ ID NO: 43 - DNA, 885 bp, Artificial Sequence
  polynucleotide for antigen E7 of HPV31, 52 and 58 full
  CDS (1)..(885)
gatgaagaggatgtcatcgattccccagcaggccaagcaaagccggacaccagcaattacaatatcgtgaccttctgctgccaatgtgagtccactctgcgtctgtgcgttcagagcacccaggttgacattcgtattctgcaagaattgttgatgggtagctttggcattgtgtgtccgaactgcagcacccgtctgagcgatgaagaggacaccgacggtgtcgaccgtccggacggccaagctgagcaggcgaccagcaactactatatcgttacgtactgtcacagctgcgatagcactctgcgcctgtgtattcatagcacggccaccgatctgcgtaccctgcaacaactgctgatgggtactctgcaggttgtgtgcccaggttgtgctcgtctgtccgacgaggacgaaatcggcctggaccgtcctgatggccaggcccagccggcaacggcgaactattacattgtgacctgctgctatacgtgcgataccacggtccgtctgtgcattaactctaccaccacggatgttcgcacgctgcagcaactgctgatgggtacctgtaccattgtttgcccgtcttgtgcccagcagatgcgcggtgaaacgccgaccctgcaggattatgttctggacctgcaaccggaggcgaccgatctgtattgctacgagcaactgccggacagctcgatgcgtggtgacaaggcgacgattaaggactacatcttggatctgcagccggaaaccaccgacctgcactgctatgagcagctgggtgattctatgcgcggtaacaatccgaccctgcgcgagtacattctggacttgcatccggaaccgacggacctgttctgttacgagcagctgtgtgacagc

SEQ ID NO: 44 - protein, 295 aa, Artificial Sequence
  Synthetic Construct
DEEDVIDSPAGQAKPDTSNYNIVTFCCQCESTLRLCVQSTQVDIRILQELLMGSFGIVCPNCSTRLSDEEDTDGVDRPDGQAEQATSNYYIVTYCHSCDSTLRLCIHSTATDLRTLQQLLMGTLQVVCPGCARLSDEDEIGLDRPDGQAQPATANYYIVTCCYTCDTTVRLCINSTTTDVRTLQQLLMGTCTIVCPSCAQQMRGETPTLQDYVLDLQPEATDLYCYEQLPDSSMRGDKATIKDYILDLQPETTDLHCYEQLGDSMRGNNPTLREYILDLHPEPTDLFCYEQLCDS

SEQ ID NO: 45 - DNA, 759 bp, Artificial Sequence
  polynucleotide for antigen E7 of HPV31, 33 and 52 acidic-deleted
  CDS (1)..(759)
gcgggtcaagccaaaccggatacctccaactacaacattgtgaccttctgttgtcaatgcgagagcacgctgcgtctgtgtgttcaaagcacccaggttgacattcgtatcctgcaagaactgctgatgggctcttttggcatcgtctgcccaaattgcagcactcgcctgggtcaggcgcaaccggccacggcggactactatatcgtgacctgttgccacacctgcaacactaccgttcgcttgtgtgtcaatagcaccgcttccgatctgcgtaccattcaacaactgctgatgggtaccgttaacatcgtgtgcccgagctgcgcacagctgggccaggcggagcaggcgacgagcaactactacattgtcacgtattgccattcctgtgatagcactctgcgtctgtgtatccacagcacggcaaccgatctgcgtaccttgcaacaactgctgatgggcaccctgcaggtggtttgtccgggttgcgctcgcctgatgcgtggtgaaacgccgaccctgcaggattatgtgttggacttgcagccggaggcaacggacctgtactgctatgagcagctgatgcgtggccataagccgacgctgaaagagtatattctggacctgtacccagagccgacggatttgtactgttatgaacagctgagcatgcgtggtgacaaggccaccattaaagattacatcctggacttgcaaccggaaaccaccgacctgcactgctatgagcagctgggt

SEQ ID NO: 46 - protein, 253 aa, Artificial Sequence
  Synthetic Construct
AGQAKPDTSNYNIVTFCCQCESTLRLCVQSTQVDIRILQELLMGSFGIVCPNCSTRLGQAQPATADYYIVTCCHTCNTTVRLCVNSTASDLRTIQQLLMGTVNIVCPSCAQLGQAEQATSNYYIVTYCHSCDSTLRLCIHSTATDLRTLQQLLMGTLQVVCPGCARLMRGETPTLQDYVLDLQPEATDLYCYEQLMRGHKPTLKEYILDLYPEPTDLYCYEQLSMRGDKATIKDYILDLQPETTDLHCYEQLG

SEQ ID NO: 47 - DNA, 882 bp, Artificial Sequence
  polynucleotide for antigen E7 of HPV31, 33 and 52 full
  CDS (1)..(882)
gatgaagaggatgtcatcgattccccagcaggccaagcaaagccggacaccagcaattacaatatcgtgaccttctgctgccaatgtgagtccactctgcgtctgtgcgttcagagcacccaggttgacattcgtattctgcaagaattgttgatgggtagctttggcattgtgtgtccgaactgcagcacccgtctgtcggatgaagatgaaggtctggatcgtccggatggtcaagcgcagccggcgactgcagattactatatcgtcacttgttgccacacctgcaataccaccgtgcgtctgtgtgtgaacagcacggcgagcgacctgcgcacgatccaacagttgttgatgggcaccgtgaatatcgtctgcccaagctgtgctcagttgagcgatgaagaggacaccgacggtgtcgaccgtccggacggccaagctgagcaggcgaccagcaactactatatcgttacgtactgtcacagctgcgatagcactctgcgcctgtgtattcatagcacggccaccgatctgcgtaccctgcaacaactgctgatgggtactctgcaggttgtgtgcccaggttgtgctcgtctgatgcgcggtgaaacgccgaccctgcaggattatgttctggacctgcaaccggaggcgaccgatctgtattgctacgagcaactgccggacagctcgatgcgtggtcacaaaccgacgctgaaagagtacatcctggacctgtacccggaacctacggatctgtactgttatgaacaactgagcgatagcatgcgtggtgacaaggcgacgattaaggactacatcttggatctgcagccggaaaccaccgacctgcactgctatgagcagctgggtgattct

SEQ ID NO: 48 - protein, 294 aa, Artificial Sequence
  Synthetic Construct
DEEDVIDSPAGQAKPDTSNYNIVTFCCQCESTLRLCVQSTQVDIRILQELLMGSFGIVCPNCSTRLSDEDEGLDRPDGQAQPATADYYIVTCCHTCNTTVRLCVNSTASDLRTIQQLLMGTVNIVCPSCAQLSDEEDTDGVDRPDGQAEQATSNYYIVTYCHSCDSTLRLCIHSTATDLRTLQQLLMGTLQVVCPGCARLMRGETPTLQDYVLDLQPEATDLYCYEQLPDSSMRGHKPTLKEYILDLYPEPTDLYCYEQLSDSMRGDKATIKDYILDLQPETTDLHCYEQLGDS

SEQ ID NO: 49 - DNA, 1080 bp, Artificial Sequence
  polynucleotide for antigen E7 of HPV16, 18, 33 and 45 acidic-deleted
  CDS (1)..(1080)
ggtcaggcggaaccggatcgcgcgcactacaacatcgttactttttgttgcaaatgtgattccactctgcgcctgtgtgtgcaatccacccacgtagacatccgcactctggaagacctgctgatgggtaccctgggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtattgaactggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagggtcaggcgcaaccggccacggcggactactatatcgtgacctgttgccacacctgcaacactaccgttcgcttgtgtgtcaatagcaccgcttccgatctgcgtaccattcaacaactgctgatgggtaccgttaacatcgtgtgcccgagctgcgcacagctgatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctgatgcgtggccataagccgacgctgaaagagtatattctggacctgtacccagagccgacggatttgtactgttatgaacagctgagc

SEQ ID NO: 50 - protein, 360 aa, Artificial Sequence
  Synthetic Construct
GQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQGVSHAQLPARRAEPQRHKILCVCCKCDGRIELTVESSAEDLRTLQQLFLSTLSFVCPWCATNQGQAQPATADYYIVTCCHTCNTTVRLCVNSTASDLRTIQQLLMGTVNIVCPSCAQLMHGDTPTLHEYMLDLQPETTDLYCYEQLNMHGPKATLQDIVLHLEPQNEIPVDLLCHEQLMHGPRETLQEIVLHLEPQNELDPVDLLCYEQLMRGHKPTLKEYILDLYPEPTDLYCYEQLS

SEQ ID NO: 51 - DNA, 1224 bp, Artificial Sequence
  polynucleotide for antigen E7 of HPV16, 18, 33 and 45 full
  CDS (1)..(1224)
gaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcataccatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaatcggatgaagatgaaggtctggatcgtccggatggtcaagcgcagccggcgactgcagattactatatcgtcacttgttgccacacctgcaataccaccgtgcgtctgtgtgtgaacagcacggcgagcgacctgcgcacgatccaacagttgttgatgggcaccgtgaatatcgtctgcccaagctgtgctcagttgatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaaatgcgtggtcacaaaccgacgctgaaagagtacatcctggacctgtacccggaacctacggatctgtactgttatgaacaactgagcgatagc

SEQ ID NO: 52 - protein, 408 aa, Artificial Sequence
  Synthetic Construct
EDEIDGPAGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQENDEADGVSHAQLPARRAEPQRHKILCVCCKCDGRIELTVESSAEDLRTLQQLFLSTLSFVCPWCATNQSDEDEGLDRPDGQAQPATADYYIVTCCHTCNTTVRLCVNSTASDLRTIQQLLMGTVNIVCPSCAQLMHGDTPTLHEYMLDLQPETTDLYCYEQLNDSSEEMHGPKATLQDIVLHLEPQNEIPVDLLCHEQLSDSEEENDEIDMHGPRETLQEIVLHLEPQNELDPVDLLCYEQLSESEEMRGHKPTLKEYILDLYPEPTDLYCYEQLSDS

SEQ ID NO: 53 - DNA, 1080 bp, Artificial Sequence
  polynucleotide for antigen E7 of HPV16, 18, 45 and 58 acidic-deleted
  CDS (1)..(1080)
ggtcaggcggaaccggatcgcgcgcactacaacatcgttactttttgttgcaaatgtgattccactctgcgcctgtgtgtgcaatccacccacgtagacatccgcactctggaagacctgctgatgggtaccctgggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtattgaactggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagggccaggcgcagccagcgacggccaattactacatcgttacctgttgctatacgtgcgatactaccgtccgtctgtgcattaacagcaccaccacggacgtgcgtaccctgcaacagctgctgatgggtacctgcacgattgtttgtccgagctgtgcacaacaaatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctgatgcgcggtaataacccgaccttgcgtgagtatatcttggacctgcacccggagccgaccgatctgttctgttacgaacagctgtgc

SEQ ID NO: 54 - protein, 360 aa, Artificial Sequence
  Synthetic Construct
GQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQGVSHAQLPARRAEPQRHKILCVCCKCDGRIELTVESSAEDLRTLQQLFLSTLSFVCPWCATNQGQAQPATANYYIVTCCYTCDTTVRLCINSTTTDVRTLQQLLMGTCTIVCPSCAQQMHGDTPTLHEYMLDLQPETTDLYCYEQLNMHGPKATLQDIVLHLEPQNEIPVDLLCHEQLMHGPRETLQEIVLHLEPQNELDPVDLLCYEQLMRGNNPTLREYILDLHPEPTDLFCYEQLC

SEQ ID NO: 55 - DNA, 1227 bp, Artificial Sequence
  polynucleotide for antigen E7 of HPV16, 18, 45 and 58  full
  CDS (1)..(1227)
gaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcataccatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaatccgacgaggacgaaatcggcctggaccgtcctgatggccaggcccagccggcaacggcgaactattacattgtgacctgctgctatacgtgcgataccacggtccgtctgtgcattaactctaccaccacggatgttcgcacgctgcagcaactgctgatgggtacctgtaccattgtttgcccgtcttgtgcccagcagatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaaatgcgcggtaacaatccgaccctgcgcgagtacattctggacttgcatccggaaccgacggacctgttctgttacgagcagctgtgtgacagc

SEQ ID NO: 56 - protein, 409 aa, Artificial Sequence
  Synthetic Construct
EDEIDGPAGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQENDEADGVSHAQLPARRAEPQRHKILCVCCKCDGRIELTVESSAEDLRTLQQLFLSTLSFVCPWCATNQSDEDEIGLDRPDGQAQPATANYYIVTCCYTCDTTVRLCINSTTTDVRTLQQLLMGTCTIVCPSCAQQMHGDTPTLHEYMLDLQPETTDLYCYEQLNDSSEEMHGPKATLQDIVLHLEPQNEIPVDLLCHEQLSDSEEENDEIDMHGPRETLQEIVLHLEPQNELDPVDLLCYEQLSESEEMRGNNPTLREYILDLHPEPTDLFCYEQLCDS

SEQ ID NO: 57 - DNA, 5670 bp, Artificial Sequence
  nucleotide encoding chimeric CyaA delta 93+ antigen HPV16, HPV18 and HPV45 acidic-deleted
  CDS (1)..(5670)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctggtcaggcggaaccggatcgcgcgcactacaacatcgttactttttgttgcaaatgtgattccactctgcgcctgtgtgtgcaatccacccacgtagacattcgcactctggaagacctgctgatgggtacccttggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtatcgagctggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctggaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 58 - protein, 1889 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQGVSHAQLPARRAEPQRHKILCVCCKCDGRIELTVESSAEDLRTLQQLFLSTLSFVCPWCATNQMHGDTPTLHEYMLDLQPETTDLYCYEQLNMHGPKATLQDIVLHLEPQNEIPVDLLCHEQLMHGPRETLQEIVLHLEPQNELDPVDLLCYEQLESQMLTRGQLKEYIGQQRGEGYVFYENRAYGVAGKSLFDDGLGAAPGVPSGRSKFSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 59 - DNA, 12000 bp, Artificial Sequence
  plasmid comprising SEQ ID NO:57
atcgagatctgtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaattataattttgtttaactttaagaaggagatatacatatgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctggtcaggcggaaccggatcgcgcgcactacaacatcgttactttttgttgcaaatgtgattccactctgcgcctgtgtgtgcaatccacccacgtagacattcgcactctggaagacctgctgatgggtacccttggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtatcgagctggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctggaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaatggatccaggcctctttagaaggagatataccatgctgccgtctgcacaggcgccgtctctgctgaatccaactgatgacttcgctgcgctgggtaacatcgcgtggctgtggatgaacagcccgatgcaccgtgactggccggttcacctgctggcacgtaacacgctggcgccgatccagctgggtcaatacatcctgctgcgttgtaacgacgtgcctgtggcgtattgctcctgggcactgatggatgcggataccgagctgtcctacgttatggccccatctagcctgggcggtaacgcttggaactgcggcgatcgtctgtggatcattgattggattgctccgtttagccgtgacgacaaccgtgctctgcgtcgcgcgctggccgaacgtcatccggattctgttggccgttccctgcgcgtacgtcgcggtggcgacaccgctcgcgtcaaagaataccgtggtcgtgctctggacgcagcggcggcccgcgctcagctggaccgctaccacgcagaactgattgccggtctgcgtgcatccaatggcggttatgctccgcgtggccgtggcaccgcataatctagaattctttaattaaagatccggctgctaacaaagcccgaaaggaagctgagttggctgctgccaccgctgagcaatccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgactcatagctgtttcctgtgtgaaattgttatccgctcacaattccacacaacatacgagccggaagcataaagtgtaaagcctggggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgctagcgtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaatttatgcggtgtgaaataccgcacagatgcgtaaggagaaaataccgcatcaggcgctcttccgcttcctcgctcactgactcgctgccaccccgtggcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 60 - DNA, 5340 bp, Artificial Sequence
  nucleotide encoding chimeric CyaA delta 203+ antigen HPV16, HVP18 and HPV45 acidic-deleted
  CDS (1)..(5340)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattggtcaggcggaaccggatcgcgcgcactacaacatcgttactttttgttgcaaatgtgattccactctgcgcctgtgtgtgcaatccacccacgtagacattcgcactctggaagacctgctgatgggtacccttggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtatcgagctggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctgccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 61 - protein, 1779 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQGVSHAQLPARRAEPQRHKILCVCCKCDGRIELTVESSAEDLRTLQQLFLSTLSFVCPWCATNQMHGDTPTLHEYMLDLQPETTDLYCYEQLNMHGPKATLQDIVLHLEPQNEIPVDLLCHEQLMHGPRETLQEIVLHLEPQNELDPVDLLCYEQLPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 62 - DNA, 11670 bp, Artificial Sequence
  plasmid comprising SEQ ID NO:60.
atcgagatctgtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaattataattttgtttaactttaagaaggagatatacatatgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattggtcaggcggaaccggatcgcgcgcactacaacatcgttactttttgttgcaaatgtgattccactctgcgcctgtgtgtgcaatccacccacgtagacattcgcactctggaagacctgctgatgggtacccttggtattgtttgtccgatttgctcccagaagccggcgtctggcgttaaccaccaacacctgccggcgcgtcgcgcagagccgcagcgtcacaccatgctgtgcatgtgctgtaaatgtgaggcccgtatcgagctggtcgttgagtctagcgccgacgatctgcgtgcgtttcagcagctgttcctgaacacgctgagcttcgtttgcccgtggtgtgctagccagcagggcgtgtctcacgctcagctgccggcacgtcgtgctgagcctcagcgtcacaaaatcctgtgcgtgtgctgcaaatgcgatggccgcatcgaactgaccgtggaatctagcgcagaagacctgcgtacgctgcagcaactgttcctgagcacgctgtccttcgtatgcccttggtgcgcaactaatcagatgcacggtgacaccccgaccctgcacgaatacatgctggacctgcagccagaaaccaccgatctgtactgttacgaacagctgaacatgcatggcccaaaagctactctgcaggatatcgtcctgcatctggaaccacagaacgaaatcccggtagatctgctgtgccatgagcagctgatgcatggtccgcgtgaaaccctgcaggaaatcgttctgcacctggaaccgcaaaacgaactggacccggttgacctgctgtgctatgaacagctgccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaatggatccaggcctctttagaaggagatataccatgctgccgtctgcacaggcgccgtctctgctgaatccaactgatgacttcgctgcgctgggtaacatcgcgtggctgtggatgaacagcccgatgcaccgtgactggccggttcacctgctggcacgtaacacgctggcgccgatccagctgggtcaatacatcctgctgcgttgtaacgacgtgcctgtggcgtattgctcctgggcactgatggatgcggataccgagctgtcctacgttatggccccatctagcctgggcggtaacgcttggaactgcggcgatcgtctgtggatcattgattggattgctccgtttagccgtgacgacaaccgtgctctgcgtcgcgcgctggccgaacgtcatccggattctgttggccgttccctgcgcgtacgtcgcggtggcgacaccgctcgcgtcaaagaataccgtggtcgtgctctggacgcagcggcggcccgcgctcagctggaccgctaccacgcagaactgattgccggtctgcgtgcatccaatggcggttatgctccgcgtggccgtggcaccgcataatctagaattctttaattaaagatccggctgctaacaaagcccgaaaggaagctgagttggctgctgccaccgctgagcaatccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgactcatagctgtttcctgtgtgaaattgttatccgctcacaattccacacaacatacgagccggaagcataaagtgtaaagcctggggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgctagcgtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaatttatgcggtgtgaaataccgcacagatgcgtaaggagaaaataccgcatcaggcgctcttccgcttcctcgctcactgactcgctgccaccccgtggcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 63 - DNA, 5775 bp, Artificial Sequence
  Nucleotide encoding chimeric CyaA delta 93+ antigen HPV16, HVP18 and HPV45 full
  CDS (1)..(5775)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctgaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcacacgatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaaatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaagaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 64 - protein, 1924 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIPLTADIDMFAIMPHLSNFRDSARSSVTSGDSVTDYLARTRRAASEDEIDGPAGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQENDEADGVSHAQLPARRAEPQRHKILCVCCKCDGRIELTVESSAEDLRTLQQLFLSTLSFVCPWCATNQMHGDTPTLHEYMLDLQPETTDLYCYEQLNDSSEEMHGPKATLQDIVLHLEPQNEIPVDLLCHEQLSDSEEENDEIDMHGPRETLQEIVLHLEPQNELDPVDLLCYEQLSESEEESQMLTRGQLKEYIGQQRGEGYVFYENRAYGVAGKSLFDDGLGAAPGVPSGRSKFSPDVLETVPASPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 65 - DNA, 12105 bp, Artificial Sequence
  Plasmid comprising SEQ ID NO:63
atcgagatctgtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaattataattttgtttaactttaagaaggagatatacatatgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctgaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcacacgatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaaatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaagaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaatggatccaggcctctttagaaggagatataccatgctgccgtctgcacaggcgccgtctctgctgaatccaactgatgacttcgctgcgctgggtaacatcgcgtggctgtggatgaacagcccgatgcaccgtgactggccggttcacctgctggcacgtaacacgctggcgccgatccagctgggtcaatacatcctgctgcgttgtaacgacgtgcctgtggcgtattgctcctgggcactgatggatgcggataccgagctgtcctacgttatggccccatctagcctgggcggtaacgcttggaactgcggcgatcgtctgtggatcattgattggattgctccgtttagccgtgacgacaaccgtgctctgcgtcgcgcgctggccgaacgtcatccggattctgttggccgttccctgcgcgtacgtcgcggtggcgacaccgctcgcgtcaaagaataccgtggtcgtgctctggacgcagcggcggcccgcgctcagctggaccgctaccacgcagaactgattgccggtctgcgtgcatccaatggcggttatgctccgcgtggccgtggcaccgcataatctagaattctttaattaaagatccggctgctaacaaagcccgaaaggaagctgagttggctgctgccaccgctgagcaatccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgactcatagctgtttcctgtgtgaaattgttatccgctcacaattccacacaacatacgagccggaagcataaagtgtaaagcctggggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgctagcgtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaatttatgcggtgtgaaataccgcacagatgcgtaaggagaaaataccgcatcaggcgctcttccgcttcctcgctcactgactcgctgccaccccgtggcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 66 - DNA, 5445 bp, Artificial Sequence
  Nucleotide encoding chimeric CyaA delta 203+ antigen HPV16, HVP18 and HPV45 full
  CDS (1)..(5445)
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattgaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtcgcgctgaaccacagcgtcacacgatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaaatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaaccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 67 - protein, 1814 aa, Artificial Sequence
  Synthetic Construct
MQQSHQAGYANAADRESGIPAAVLDGIKAVAKEKNATLMFRLVNPHSTSLIAEGVATKGLGVHAKSSDWGLQAGYIPVNPNLSKLFGRAPEVIARADNDVNSSLAHGHTAVDLTLSKERLDYLRQAGLVTGMADGVVASNHAGYEQFEFRVKETSDGRYAVQYRRKGGDDFEAVKVIGNAAGIEDEIDGPAGQAEPDRAHYNIVTFCCKCDSTLRLCVQSTHVDIRTLEDLLMGTLGIVCPICSQKPASGVNHQHLPARRAEPQRHTMLCMCCKCEARIELVVESSADDLRAFQQLFLNTLSFVCPWCASQQENDEADGVSHAQLPARRAEPQRHKILCVCCKCDGRIELTVESSAEDLRTLQQLFLSTLSFVCPWCATNQMHGDTPTLHEYMLDLQPETTDLYCYEQLNDSSEEMHGPKATLQDIVLHLEPQNEIPVDLLCHEQLSDSEEENDEIDMHGPRETLQEIVLHLEPQNELDPVDLLCYEQLSESEEPGLRRPSLGAVERQDSGYDSLDGVGSRSFSLGEVSDMAAVEAAELEMTRQVLHAGARQDDAEPGVSGASAHWGQRALQGAQAVAAAQRLVHAIALMTQFGRAGSTNTPQEAASLSAAVFGLGEASSAVAETVSGFFRGSSRWAGGFGVAGGAMALGGGIAAAVGAGMSLTDDAPAGQKAAAGAEIALQLTGGTVELASSIALALAAARGVTSGLQVAGASAGAAAGALAAALSPMEIYGLVQQSHYADQLDKLAQESSAYGYEGDALLAQLYRDKTAAEGAVAGVSAVLSTVGAAVSIAAAASVVGAPVAVVTSLLTGALNGILRGVQQPIIEKLANDYARKIDELGGPQAYFEKNLQARHEQLANSDGLRKMLADLQAGWNASSVIGVQTTEISKSALELAAITGNADNLKSVDVFVDRFVQGERVAGQPVVLDVAAGGIDIASRKGERPALTFITPLAAPGEEQRRRTKTGKSEFTTFVEIVGKQDRWRIRDGAADTTIDLAKVVSQLVDANGVLKHSIKLDVIGGDGDDVVLANASRIHYDGGAGTNTVSYAALGRQDSITVSADGERFNVRKQLNNANVYREGVATQTTAYGKRTENVQYRHVELARVGQLVEVDTLEHVQHIIGGAGNDSITGNAHDNFLAGGSGDDRLDGGAGNDTLVGGEGQNTVIGGAGDDVFLQDLGVWSNQLDGGAGVDTVKYNVHQPSEERLERMGDTGIHADLQKGTVEKWPALNLFSVDHVKNIENLHGSRLNDRIAGDDQDNELWGHDGNDTIRGRGGDDILRGGLGLDTLYGEDGNDIFLQDDETVSDDIDGGAGLDTVDYSAMIHPGRIVAPHEYGFGIEADLSREWVRKASALGVDYYDNVRNVENVIGTSMKDVLIGDAQANTLMGQGGDDTVRGGDGDDLLFGGDGNDMLYGDAGNDTLYGGLGDDTLEGGAGNDWFGQTQAREHDVLRGGDGVDTVDYSQTGAHAGIAAGRIGLGILADLGAGRVDKLGEAGSSAYDTVSGIENVVGTELADRITGDAQANVLRGAGGADVLAGGEGDDVLLGGDGDDQLSGDAGRDRLYGEAGDDWFFQDAANAGNLLDGGDGRDTVDFSGPGRGLDAGAKGVFLSLGKGFASLMDEPETSNVLRNIENAVGSARDDVLIGDAGANVLNGLAGNDVLSGGAGDDVLLGDEGSDLLSGDAGNDDLFGGQGDDTYLFGVGYGHDTIYESGGGHDTIRINAGADQLWFARQGNDLEIRILGTDDALTVHDWYRDADHRVEIIHAANQAVDQAGIEKLVEAMAQYPDPGAAAAAPPAARVPDTLMQSLAVNWR

SEQ ID NO: 68 - DNA, 11776 bp, Artificial Sequence
  Plasmid comprising SEQ ID NO:65
atcgagatctgtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaattataattttgtttaactttaagaaggagatatacatatgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattgaagacgaaatcgacggccctgcgggccaggctgaaccagatcgtgctcactacaacatcgtaactttttgctgtaagtgcgatagcactctgcgtctgtgcgtacagtctactcacgttgatatccgcactctggaagatctgctgatgggtaccctgggtatcgtctgcccaatctgctctcaaaagcctgcttctggtgttaaccatcagcacctgccggctcgtctgcgctgaaccacagcgtcacacgatgctgtgcatgtgttgcaaatgcgaggctcgcatcgaactggttgttgaatccagcgctgacgacctgcgtgcgtttcagcaactgttcctgaacacgctgtcttttgtttgtccgtggtgtgcctcccagcaggagaacgatgaagcggatggcgtgtcccacgcgcagctgccggcacgtcgtgcagaaccgcagcgccacaagattctgtgcgtttgctgtaaatgtgatggccgtatcgaactgactgtggaatcctccgcggaagatctgcgtacgctgcagcagctgttcctgtctaccctgtctttcgtgtgcccgtggtgcgccaccaatcaaatgcacggcgacaccccgaccctgcacgaatacatgctggacctgcagccggaaaccacggatctgtattgttatgaacagctgaacgatagcagcgaggaaatgcacggtccgaaagcaactctgcaggacattgtgctgcatctggagccacagaacgaaatcccggttgatctgctgtgccacgagcaactgagcgattccgaagaggaaaacgacgaaattgatatgcatggtccgcgcgagaccctgcaagaaatcgtcctgcacctggaaccgcaaaacgaactggaccctgtagacctgctgtgctacgaacagctgtccgaatctgaagaaccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaatggatccaggcctctttagaaggagatataccatgctgccgtctgcacaggcgccgtctctgctgaatccaactgatgacttcgctgcgctgggtaacatcgcgtggctgtggatgaacagcccgatgcaccgtgactggccggttcacctgctggcacgtaacacgctggcgccgatccagctgggtcaatacatcctgctgcgttgtaacgacgtgcctgtggcgtattgctcctgggcactgatggatgcggataccgagctgtcctacgttatggccccatctagcctgggcggtaacgcttggaactgcggcgatcgtctgtggatcattgattggattgctccgtttagccgtgacgacaaccgtgctctgcgtcgcgcgctggccgaacgtcatccggattctgttggccgttccctgcgcgtacgtcgcggtggcgacaccgctcgcgtcaaagaataccgtggtcgtgctctggacgcagcggcggcccgcgctcagctggaccgctaccacgcagaactgattgccggtctgcgtgcatccaatggcggttatgctccgcgtggccgtggcaccgcataatctagaattctttaattaaagatccggctgctaacaaagcccgaaaggaagctgagttggctgctgccaccgctgagcaatccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgactcatagctgtttcctgtgtgaaattgttatccgctcacaattccacacaacatacgagccggaagcataaagtgtaaagcctggggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgctagcgtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaatttatgcggtgtgaaataccgcacagatgcgtaaggagaaaataccgcatcaggcgctcttccgcttcctcgctcactgactcgctgccaccccgtggcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 69 - DNA, 5121 bp, Artificial Sequence
  Nucleotide sequence encoding the wild type CyaA protein of Bordetella pertussis, optimized for E. coli expression
atgcagcagtcccatcaggccggttacgcaaacgcagccgatcgtgaatctggtatcccggcagcggttctggatggtattaaggcagttgccaaagagaagaacgctaccctgatgttccgtctggtcaacccacactctacttccctgatcgcggaaggtgtggcgaccaaaggcctgggtgtgcacgccaaaagcagcgactggggtctgcaggcaggttatattccggtgaacccgaatctgtctaaactgttcggtcgtgccccggaggtgatcgcacgtgcagacaacgatgtcaactcttctctggcgcatggtcacaccgcggttgatctgaccctgtccaaagaacgcctggattacctgcgtcaggcgggcctggtgacgggcatggccgacggtgttgtagcgagcaaccacgcgggttatgaacaatttgagtttcgcgttaaagagacctctgacggtcgttacgcggtgcagtaccgccgcaaaggtggcgatgactttgaagctgtcaaagtgatcggtaacgctgctggaattccgctgaccgcggatatcgacatgtttgccatcatgcctcacctgtccaactttcgcgattccgcacgcagctctgtgacgtctggtgattccgtcactgactacctggctcgtacccgtcgtgcggcctctgaagccactggtggtctggatcgtgaacgcattgacctgctgtggaaaatcgcccgtgccggtgcgcgctctgctgttggtaccgaagcacgccgccaatttcgttacgacggcgatatgaacatcggtgtgatcacggattttgaactggaagttcgcaatgccctgaaccgtcgtgcacacgcggtcggcgcgcaggacgttgttcagcacggtacggagcagaataacccgttcccagaagcggacgaaaagatctttgttgtgtctgccaccggtgaatcccagatgctgactcgtggccagctgaaagaatacatcggccaacagcgtggcgaaggctacgttttctacgagaatcgtgcttacggcgttgcgggcaaatccctgttcgacgatggtctgggcgctgcaccgggcgttccgagcggccgttctaaattcagcccggacgtactggaaactgtgccggcttccccgggcctgcgccgtccgtccctgggcgcagtcgaacgtcaggactccggctacgattccctggatggcgttggctcccgctccttctccctgggcgaggtttctgacatggctgcggtggaagcggcagagctggaaatgacccgtcaagtgctgcacgcgggcgcacgtcaggacgatgctgagccgggcgtgtccggtgcgtctgcacactggggtcaacgtgccctgcagggtgctcaagctgtcgcggcagcgcagcgtctggtacatgcgatcgcactgatgacccagttcggtcgcgcaggttctaccaacactcctcaggaagcagctagcctgtctgctgctgttttcggtctgggcgaagcgtcttctgcggttgcagaaaccgtgagcggtttcttccgtggttctagccgctgggcgggtggttttggtgtagcaggtggcgctatggccctgggtggcggtatcgcggctgctgtcggcgcaggtatgagcctgaccgacgatgctcctgcgggccagaaagccgcagctggcgctgaaatcgcgctgcagctgactggtggtaccgttgaactggctagctctatcgcgctggctctggcagcggcacgtggcgtgacttctggcctgcaagtcgccggtgcctctgcgggcgctgctgcgggcgctctggcagctgcactgtcccccatggaaatctacggtctggtacagcagtctcactacgcagaccagctggataaactggcgcaggagtcttctgcatacggttacgaaggcgacgcactgctggcgcagctgtatcgtgacaaaactgctgctgaaggtgctgtggcaggcgtttctgcggtactgtctaccgttggcgctgcggtttctattgcggctgccgcatccgttgtaggtgcgccggttgctgtagttacctctctgctgactggtgcactgaacggtatcctgcgtggtgttcagcagcctattatcgaaaaactggcgaatgattatgcccgtaaaatcgacgaactgggcggtccgcaggcttattttgaaaaaaacctgcaggcgcgccacgaacagctggcaaacagcgacggcctgcgcaaaatgctggcagacctgcaagctggttggaacgcgtcttctgtgatcggcgtgcagaccaccgaaattagcaaatctgcgctggaactggctgcaattactggcaacgcggataacctgaaaagcgttgatgtttttgtcgatcgcttcgttcagggcgagcgcgttgctggtcagccggttgttctggacgttgcggcaggcggcatcgacatcgctagccgcaagggcgagcgtccggctctgactttcattaccccgctggcagctccgggtgaagaacagcgtcgccgtaccaagactggtaaaagcgagttcaccaccttcgtggaaatcgtaggtaaacaggaccgctggcgtattcgcgacggtgcggcggacaccaccatcgacctggcaaaagttgtttcccaactggtagatgctaacggcgtgctgaaacattctattaaactggatgtaatcggcggtgacggcgatgacgttgtactggcgaacgcgtctcgtatccactatgacggcggcgcaggtaccaacacggtttcctacgcagcgctgggccgccaggattccatcactgttagcgccgatggcgaacgtttcaacgtgcgtaaacagctgaataacgcaaacgtctatcgtgagggtgtagctacccagaccaccgcgtacggtaagcgtaccgaaaacgttcagtatcgtcacgtggaactggcacgtgtgggtcagctggtagaggtggatacgctggaacacgtgcagcacatcatcggtggcgccggtaacgattccattactggtaacgctcacgacaacttcctggcaggtggttctggtgatgatcgtctggacggtggtgcgggtaacgatacgctggtaggcggcgaaggtcagaacaccgtaattggtggtgccggtgacgacgttttcctgcaggatctgggcgtttggagcaaccagctggatggcggtgccggtgttgacacggttaagtataacgttcaccagccgtctgaagagcgcctggaacgtatgggtgacactggtattcatgccgatctgcagaaaggcactgttgaaaaatggcctgcgctgaacctgttctctgtggaccatgttaagaacattgaaaacctgcatggctctcgcctgaacgaccgtatcgctggtgacgaccaggataacgaactgtggggtcatgacggcaatgataccattcgcggtcgtggcggcgacgatattctgcgtggcggtctgggcctggataccctgtatggtgaagatggtaacgatattttcctgcaagacgatgaaacggtatctgatgacatcgacggtggtgcaggcctggacaccgtagattacagcgctatgatccatccgggtcgtatcgtagctccgcacgagtacggcttcggtatcgaggcggacctgtctcgtgaatgggttcgtaaagcgtccgcgctgggtgtggactactacgataacgttcgtaacgtggaaaacgtgatcggtacctccatgaaagacgtgctgattggcgacgcacaggccaacactctgatgggccagggcggtgatgacacggttcgcggcggcgacggtgatgacctgctgttcggtggtgacggcaacgacatgctgtacggcgacgcgggcaacgacaccctgtacggcggtctgggtgacgacactctggaaggtggtgcaggtaacgactggttcggccaaacccaggcacgcgaacacgacgtgctgcgtggtggcgacggcgtagacaccgtggattactcccaaactggcgctcacgcgggtatcgcggccggtcgtatcggtctgggcattctggccgatctgggtgccggccgtgtcgacaaactgggtgaggctggctctagcgcctatgatactgtttccggcatcgaaaacgtggtaggcactgaactggcagatcgtatcacgggtgacgcgcaagcgaacgttctgcgtggtgctggcggtgcagacgtgctggcgggtggtgaaggcgacgacgtactgctgggcggtgacggtgacgatcagctgagcggtgatgcgggtcgtgaccgtctgtacggtgaagcaggtgacgattggttcttccaggacgctgctaacgctggcaacctgctggacggcggcgatggccgtgacactgttgacttcagcggtccgggtcgcggtctggacgcaggcgcgaaaggcgttttcctgagcctgggtaagggtttcgcatctctgatggacgaaccagaaaccagcaatgtcctgcgtaacatcgaaaacgctgtcggttccgcacgcgatgatgttctgattggcgatgctggtgccaatgttctgaacggtctggcgggtaatgatgtactgtctggtggcgctggtgatgatgtcctgctgggtgatgagggcagcgatctgctgtccggcgatgccggcaacgacgatctgttcggtggccaaggtgatgatacttacctgttcggcgttggctatggtcatgacaccatctatgagtctggtggcggccacgatacgattcgtattaatgcaggtgctgaccaactgtggtttgcacgtcagggtaacgatctggaaattcgcatcctgggtactgatgacgctctgaccgtacacgactggtaccgcgatgcggatcaccgcgtagaaatcatccatgcggctaaccaagctgtagaccaggctggtattgaaaaactggtagaagcgatggcacagtatccggacccaggtgcggctgctgcagcacctccagcggctcgtgtgccggataccctgatgcagagcctggccgtcaattggcgttaa

SEQ ID NO: 70 - protein, 85 aa, Artificial Sequence
  PEP225 complete sequence 85 aa (Hpv31E742-98/1-28)
AGQAKPDTSNYNIVTFCCQCESTLRLCVQSTQVDIRILQELLMGSFGIVCPNCSTRLMRGETPTLQDYVLDLQPEATDLYCYEQL

SEQ ID NO: 71 - protein, 84 aa, Artificial Sequence
  PEP226 complete sequence 84 aa (Hpv33E743-97/1-29)
GQAQPATADYYIVTCCHTCNTTVRLCVNSTASDLRTIQQLLMGTVNIVCPSCAQLMRGHKPTLKEYILDLYPEPTDLYCYEQLS

SEQ ID NO: 72 - protein, 95 aa, Artificial Sequence
  PEP215 complete sequence 95aa (HPV45E7 44-106/1-32)
GVSHAQLPARRAEPQRHKILCVCCKCDGRIELTVESSAEDLRTLQQLFLSTLSFVCPWCATNQMHGPRETLQEIVLHLEPQNELDPVDLLCYEQL

SEQ ID NO: 73 - protein, 84 aa, Artificial Sequence
  PEP235 complete sequence 84 aa (Hpv52E745-99/1-29 modified to deleted an auto-immune antigen)
GQAEQATSNYYIVTYCHSCDSTLRLCIHSTATDLRTLQQLLMGTLQVVCPGCARLMRGDKATIKDYILDLQPETTDLHCYEQLG

SEQ ID NO: 74 - protein, 84 aa, Artificial Sequence
  PEP228 complete sequence 84 aa (HPV58E744-98/1-29)
GQAQPATANYYIVTCCYTCDTTVRLCINSTTTDVRTLQQLLMGTCTIVCPSCAQQMRGNNPTLREYILDLHPEPTDLFCYEQLC

SEQ ID NO: 75 - DNA, 255 bp, Artificial Sequence
  DNA SEQUENCE OF PEP225 (Hpv31E742-98/1-28) >pep225 complete sequence 255 bp
gcgggtcaagccaaaccggatacctccaactacaacattgtgaccttctgttgtcaatgcgagagcacgctgcgtctgtgtgttcaaagcacccaggttgacattcgtatcctgcaagaactgctgatgggctcttttggcatcgtctgcccaaattgcagcactcgcctgatgcgtggtgaaacgccgaccctgcaggattatgtgttggacttgcagccggaggcaacggacctgtactgctatgagcagctg

SEQ ID NO: 76 - DNA, 252 bp, Artificial Sequence
  DNA SEQUENCE OF PEP226  (Hpv33E743-97/1-29) >pep226 complete sequence 252 bp
ggtcaggcgcaaccggccacggcggactactatatcgtgacctgttgccacacctgcaacactaccgttcgcttgtgtgtcaatagcaccgcttccgatctgcgtaccattcaacaactgctgatgggtaccgttaacatcgtgtgcccgagctgcgcacagctgatgcgtggccataagccgacgctgaaagagtatattctggacctgtacccagagccgacggatttgtactgttatgaacagctgagc

SEQ ID NO: 77 - DNA, 285 bp, Artificial Sequence
  DNA SEQUENCE OF PEP215 (HPV45E7 44-106/1-32) >pep215 complete sequence 285 bp
ggtgtttctcacgcacaactgccagcgcgtcgcgcggaaccgcaacgtcataagatcctgtgtgtgtgctgcaaatgcgacggccgcattgagctgactgtagaatcctctgctgaagacctgcgtacgctgcagcagctgtttctgagcaccctgtctttcgtctgtccttggtgcgccaccaaccagatgcacggtccgcgtgagaccctgcaggaaatcgtgctgcacctggaaccgcagaatgaactggacccggttgatctgctgtgttacgaacagctg

SEQ ID NO: 78 - DNA, 252 bp, Artificial Sequence
  DNA SEQUENCE OF PEP235 (Hpv52E745-99/1-29 modified to delete an auto-immune antigen >pep235 complete sequence 252 bp
ggccaggcggagcaggcgacgagcaactactacattgtcacgtattgccattcctgtgatagcactctgcgtctgtgtatccacagcacggcaaccgatctgcgtaccttgcaacaactgctgatgggcaccctgcaggtggtttgtccgggttgcgctcgcctgatgcgtggtgacaaggccaccattaaagattacatcctggacttgcaaccggaaaccaccgacctgcactgctatgagcagctgggt

SEQ ID NO: 79 - DNA, 252 bp, Artificial Sequence
  DNA SEQUENCE OF PEP228 (HPV58E744-98/1-29) >pep228 complete sequence 252 bp
ggccaggcgcagccagcgacggccaattactacatcgttacctgttgctatacgtgcgatactaccgtccgtctgtgcattaacagcaccaccacggacgtgcgtaccctgcaacagctgctgatgggtacctgcacgattgtttgtccgagctgtgcacaacaaatgcgcggtaataacccgaccttgcgtgagtatatcttggacctgcacccggagccgaccgatctgttctgttacgaacagctgtgc

The invention claimed is:

1. A polynucleotide encoding a CyaA-derived protein comprising or consisting of:
  1) a fragment of the *Bordetella pertussis* CyaA protein as set forth in SEQ ID NO: 2, wherein said fragment consists of the sequence beginning with the first residue of SEQ ID NO:2 and ending with a residue located from position 183 to position 227 of SEQ ID NO:2 or a variant thereof, wherein said variant has at least 95% similarity with said fragment, differs from said fragment only by substitution of amino acid residues and is the same length as said fragment, fused to
  2) a fragment of the *Bordetella pertussis* CyaA protein as set forth in SEQ ID NO: 2, wherein said fragment consists of the sequence beginning with a residue located from position 321 to position 387 of SEQ ID NO:2 and ending with the last residue of SEQ ID NO:2 or a variant thereof, wherein said variant has at least 95% similarity with said fragment, differs from said fragment only by substitution of amino acid residues and is the same length as said fragment, wherein said polynucleotide keeps the capacity of CyaA to bind to CD11b-expressing cells as target cells and/or to translocate its adenylate cyclase domain into the cytosol of said target cells and wherein the encoded CyaA-derived protein is devoid of enzymatic activity of CyaA.

2. The polynucleotide according to claim 1, wherein said CyaA-derived protein is selected from the group consisting of:
1) a polypeptide comprising or consisting of the sequence as set forth in SEQ ID NO:10 or a variant by amino acid substitution, wherein said variant has at least 95% similarity with SEQ ID NO:10 and is the same length as SEQ ID NO: 10;
2) a polypeptide comprising or consisting of the sequence as set forth in SEQ ID NO:12 or a variant by amino acid substitution, wherein said variant has at least 95% similarity with SEQ ID NO:12 and is the same length as SEQ ID NO: 12;
3) a polypeptide comprising or consisting of the sequence as set forth in SEQ ID NO:19 or a variant by amino acid substitution, wherein said variant has at least 95% similarity with SEQ ID NO:19 and is the same length as SEQ ID NO: 19;
4) a polypeptide comprising or consisting of the sequence as set forth in SEQ ID NO:20 or a variant by amino acid substitution, wherein said variant has at least 95% similarity with SEQ ID NO:20 and is the same length as SEQ ID NO: 20.

3. The polynucleotide according to claim 1, wherein said variant CyaA-derived protein comprises or consists of:
1) a polypeptide whose sequence is as set forth in SEQ ID NO:13;
2) a polypeptide whose sequence is as set forth in SEQ ID NO:14;
3) a polypeptide whose sequence is as set forth in SEQ ID NO:15;
4) a polypeptide whose sequence is as set forth in SEQ ID NO:16;
5) a polypeptide whose sequence is as set forth in SEQ ID NO:17; or
6) a polypeptide whose sequence is as set forth in SEQ ID NO:18.

4. A chimeric polynucleotide encoding a chimeric protein, said polynucleotide comprising or consisting of, from 5' to 3', (a) a polynucleotide encoding a fragment of the *Bordetella pertussis* CyaA protein as set forth in SEQ ID NO: 2, the sequence of said fragment beginning with the first residue of SEQ ID NO:2 and ending with a residue located between positions 183 and 227 of SEQ ID NO:2, or a variant with at least 95% similarity with said fragment, (b) a polynucleotide encoding a heterologous polypeptide and (c) a polynucleotide encoding a fragment of the *Bordetella pertussis* CyaA protein as set forth in SEQ ID NO: 2, the sequence of said fragment beginning with a residue located between positions 321 and 387 of SEQ ID NO:2 and ending with the last residue of SEQ ID NO:2 or a variant with at least 95% similarity with said fragment.

5. The chimeric polynucleotide according to claim 4 selected from the group consisting of
1) a polynucleotide comprising or consisting of, from 5' to 3', (a) a polynucleotide encoding a polypeptide fragment consisting of residues 1 to 227 of SEQ ID NO:2, 4 or 6, (b) a polynucleotide encoding a heterologous polypeptide and (c) a polynucleotide encoding a polypeptide fragment consisting of residues 321 to 1706 of SEQ ID NO:2, 4 or 6;
2) a polynucleotide comprising or consisting of, from 5' to 3', (a) a polynucleotide encoding a polypeptide fragment consisting of residues 1 to 227 of SEQ ID NO:8, (b) a polynucleotide encoding a heterologous polypeptide and (c) a polynucleotide encoding a polypeptide fragment consisting of residues 321 to 1705 of SEQ ID NO:8;
3) a polynucleotide comprising or consisting of, from 5' to 3', (a) a polynucleotide encoding a polypeptide fragment consisting of residues 1 to 183 of SEQ ID NO:2, 4 or 6, (b) a polynucleotide encoding a heterologous polypeptide and (c) a polynucleotide encoding a polypeptide fragment consisting of residues 387 to 1706 of SEQ ID NO:2, 4 or 6;
4) a polynucleotide comprising or consisting of, from 5' to 3', (a) a polynucleotide encoding a polypeptide fragment consisting of residues 1 to 183 of SEQ ID NO:8, (b) a polynucleotide encoding a heterologous polypeptide and (c) a polynucleotide encoding a polypeptide fragment consisting of residues 387 to 1705 of SEQ ID NO:8;
5) a polynucleotide comprising or consisting of, from 5' to 3', (a) a polynucleotide encoding a polypeptide fragment consisting of residues 1 to 227 of SEQ ID NO:2, 4 or 6, (b) a polynucleotide encoding a heterologous polypeptide and (c) a polynucleotide encoding a polypeptide fragment consisting of residues 387 to 1706 of SEQ ID NO:2, 4 or 6;
6) a polynucleotide comprising or consisting of, from 5' to 3', (a) a polynucleotide encoding a polypeptide fragment consisting of residues 1 to 227 of SEQ ID NO:8, (b) a polynucleotide encoding a heterologous polypeptide and (c) a polynucleotide encoding a polypeptide fragment consisting of residues 387 to 1705 of SEQ ID NO:8;
7) a polynucleotide comprising or consisting of, from 5' to 3', (a) a polynucleotide encoding a polypeptide fragment consisting of residues 1 to 183 of SEQ ID NO:2, 4 or 6, (b) a polynucleotide encoding a heterologous polypeptide and (c) a polynucleotide encoding a polypeptide fragment consisting of residues 321 to 1706 of SEQ ID NO:2, 4 or 6; and
8) a polynucleotide comprising or consisting of, from 5' to 3', (a) a polynucleotide encoding a polypeptide fragment consisting of residues 1 to 183 of SEQ ID NO:8, (b) a polynucleotide encoding a heterologous polypeptide and (c) a polynucleotide encoding a polypeptide fragment consisting of residues 321 to 1705 of SEQ ID NO:8.

6. Method of producing a chimeric protein comprising or consisting of said CyaA-derived protein and a heterologous polypeptide, which comprises cloning the polynucleotide encoding said heterologous polypeptide is between fragments 1) and 2) of the polynucleotide encoding CyaA according to claim 1.

7. A chimeric polynucleotide according to claim 4, which further comprises, at its 3' end a polynucleotide encoding the CyaC protein of a *Bordetella* strain.

8. A vector comprising a polynucleotide according to claim 1, and expression control sequences, and optionally further comprising the cyaC coding sequence of a *Bordetella* strain.

9. A cell culture comprising a polynucleotide according to claim 1.

10. A method to produce a chimeric protein, comprising:
(a) deleting, from a polynucleotide encoding the *Bordetella* CyaA as set forth in SEQ ID NO: 2, 4, 6 or 8, a nucleotide fragment, the first three nucleotides of which encode an amino acid residue located from residue 184 to residue 228 of SEQ ID NO: 2, 4, 6 or 8, whose the last 3 nucleotides of which encode an amino acid residue located from residue 320 to residue 386 of SEQ ID NO: 2, 4, 6 or 8;
(b) inserting, in the polynucleotide obtained in (a) and at the site of the deleted nucleotide fragment, a polynucleotide encoding a heterologous polypeptide;
wherein steps (a) and (b) may be carried out in any order or simultaneously;
(c) expressing, in a cell, the polynucleotide obtained in (b); and
(d) recovering said expressed chimeric protein.

11. A method according to claim 10, which comprises the step of combining in a chimeric polynucleotide construct the polynucleotide obtained in step (b) and a polynucleotide encoding the CyaC protein, in particular the chimeric polynucleotide construct comprises the polynucleotide obtained in step (b) and a polynucleotide encoding the CyaC protein in such a way that following said combination, the obtained chimeric polynucleotide comprises or contains, from 5' end to 3' end, the polynucleotide construct of step (b) followed by a polynucleotide construct encoding a CyaC protein of a *Bordetella* strain.

12. The method according to claim 10, wherein said step a) consists in deleting, from a polynucleotide encoding a *Bordetella* CyaA as set forth in SEQ ID NO: 2, 4, 6 or 8, a nucleotide fragment encoding the residues 228 to 320 of SEQ ID NO: 2, 4, 6 or 8, or a nucleotide fragment encoding the residues 184 to 386 of SEQ ID NO: 2, 4, 6 or 8, or a nucleotide fragment encoding the residues 228 to 386 of SEQ ID NO: 2, 4, 6 or 8, or a nucleotide fragment encoding the residues 184 to 320 of SEQ ID NO: 2, 4, 6 or 8 or wherein said step a) consists in deleting, from a polynucleotide as set forth in SEQ ID NO: 1, 3, 5 or 7 or in SEQ ID NO:69, a nucleotide fragment consisting of nucleotides 682 to 960 of SEQ ID NO: 1, 3, 5 or 7 or of SEQ ID NO:69, or a nucleotide fragment consisting of nucleotides 550 to 1158 of SEQ ID NO: 1, 3, 5 or 7 or of SEQ ID NO:69, or a nucleotide fragment consisting of nucleotides 682 to 1158 of SEQ ID NO: 1, 3, 5 or 7 or of SEQ ID NO:69, or a nucleotide fragment consisting of nucleotides 550 to 960 of SEQ ID NO: 1, 3, 5 or 7 or of SEQ ID NO:69.

13. The polynucleotide according to claim 4, wherein said variant CyaA-derived protein is able to bind to target cells and/or to translocate its adenylate cyclase domain into the cytosol of target cells.

14. A vector comprising a chimeric polynucleotide according to claim 4.

15. A cell culture comprising a chimeric polynucleotide according to claim 4.

16. The vector according to claim 8 which is a plasmia.

17. The vector according to claim 14 which is a plasmia.

18. The cell culture according to claim 9 which is an *E. coli* strain.

19. The cell culture according to claim 15 which is an *E. coli* strain.

20. The chimeric polynucleotide according to claim 7, wherein the *Bordetella* strain is a *Bordetella pertussis* strain.

21. The method according to claim 11, wherein the *Bordetella* strain is a *Bordetella pertussis* strain.

* * * * *